(12) United States Patent
Bernett et al.

(10) Patent No.: US 10,858,451 B2
(45) Date of Patent: *Dec. 8, 2020

(54) BISPECIFIC ANTIBODIES THAT BIND TO CD38 AND CD3

(71) Applicant: XENCOR, INC., Monrovia, CA (US)

(72) Inventors: Matthew J. Bernett, Monrovia, CA (US); Seung Y. Chu, Cypress, CA (US); Gregory Moore, Monrovia, CA (US); John Desjarlais, Pasadena, CA (US)

(73) Assignee: Xencor, Inc., Monrovia, CA (US)

( * ) Notice: Subject to any disclaimer, the term of this patent is extended or adjusted under 35 U.S.C. 154(b) by 300 days.

This patent is subject to a terminal disclaimer.

(21) Appl. No.: 15/786,252

(22) Filed: Oct. 17, 2017

(65) Prior Publication Data

US 2018/0094079 A1 Apr. 5, 2018

Related U.S. Application Data

(63) Continuation of application No. 14/673,695, filed on Mar. 30, 2015, now Pat. No. 9,822,186.

(60) Provisional application No. 62/025,974, filed on Jul. 17, 2014, provisional application No. 62/025,931, filed on Jul. 17, 2014, provisional application No. 61/972,172, filed on Mar. 28, 2014.

(51) Int. Cl.
| | | |
|---|---|---|
| C07K 16/40 | (2006.01) | |
| C07K 16/28 | (2006.01) | |
| C07K 16/30 | (2006.01) | |
| C07K 16/18 | (2006.01) | |
| A61K 39/00 | (2006.01) | |
| C07K 16/46 | (2006.01) | |

(52) U.S. Cl.
CPC ........ *C07K 16/468* (2013.01); *C07K 16/2809* (2013.01); *C07K 16/2896* (2013.01); *C07K 16/30* (2013.01); *C07K 2317/24* (2013.01); *C07K 2317/31* (2013.01); *C07K 2317/52* (2013.01); *C07K 2317/55* (2013.01); *C07K 2317/565* (2013.01); *C07K 2317/622* (2013.01); *C07K 2317/64* (2013.01); *C07K 2317/73* (2013.01); *C07K 2317/92* (2013.01); *C07K 2317/94* (2013.01)

(58) Field of Classification Search
None
See application file for complete search history.

(56) References Cited

U.S. PATENT DOCUMENTS

| | | | |
|---|---|---|---|
| 3,773,919 A | 11/1973 | Boswell et al. | |
| 4,169,888 A | 10/1979 | Hanka et al. | |
| 4,179,337 A | 12/1979 | Davis et al. | |
| 4,256,746 A | 3/1981 | Miyashita et al. | |
| 4,294,757 A | 10/1981 | Asai | |
| 4,301,144 A | 11/1981 | Iwashita et al. | |
| 4,307,016 A | 12/1981 | Asai et al. | |
| 4,313,946 A | 2/1982 | Powell et al. | |
| 4,315,929 A | 2/1982 | Freedman et al. | |
| 4,322,348 A | 3/1982 | Asai et al. | |
| 4,331,598 A | 5/1982 | Hasegawa et al. | |
| 4,361,650 A | 11/1982 | Asai et al. | |
| 4,362,663 A | 12/1982 | Kida et al. | |
| 4,364,866 A | 12/1982 | Asai et al. | |
| 4,364,935 A | 12/1982 | Kung et al. | |
| 4,371,533 A | 2/1983 | Akimoto et al. | |
| 4,424,219 A | 1/1984 | Hashimoto et al. | |
| 4,450,254 A | 5/1984 | Isley et al. | |
| 4,496,689 A | 1/1985 | Mitra | |
| 4,640,835 A | 2/1987 | Shimizu et al. | |
| 4,670,417 A | 6/1987 | Iwasaki et al. | |
| 4,791,192 A | 12/1988 | Nakagawa et al. | |
| 4,880,935 A | 11/1989 | Thorpe | |
| 4,923,990 A | 5/1990 | Nakano et al. | |
| 4,943,533 A | 7/1990 | Mendelsohn et al. | |
| 4,970,198 A | 11/1990 | Lee et al. | |
| 5,053,394 A | 10/1991 | Ellestad et al. | |
| 5,070,092 A | 12/1991 | Kanda et al. | |
| 5,084,468 A | 1/1992 | Saito et al. | |
| 5,101,038 A | 3/1992 | Nakano et al. | |
| 5,122,368 A | 6/1992 | Greenfield et al. | |
| 5,187,186 A | 2/1993 | Kanda et al. | |
| 5,208,020 A | 5/1993 | Chari et al. | |
| 5,264,586 A | 11/1993 | Nicolaou et al. | |
| 5,384,412 A | 1/1995 | Nicolaou et al. | |
| 5,416,064 A | 5/1995 | Chari et al. | |
| 5,475,092 A | 12/1995 | Chari et al. | |
| 5,500,362 A | 3/1996 | Robinson et al. | |
| 5,530,101 A | 6/1996 | Queen et al. | |
| 5,541,087 A | 7/1996 | Lo et al. | |
| 5,550,246 A | 8/1996 | Nicolaou et al. | |
| 5,558,864 A | 9/1996 | Bendig et al. | |
| 5,585,089 A | 12/1996 | Queen et al. | |
| 5,585,097 A | 12/1996 | Bolt et al. | |
| 5,585,499 A | 12/1996 | Chari et al. | |
| 5,622,929 A | 4/1997 | Willner et al. | |
| 5,635,483 A | 6/1997 | Pettit et al. | |
| 5,641,780 A | 6/1997 | Amishiro et al. | |
| 5,663,149 A | 9/1997 | Pettit et al. | |
| 5,677,171 A | 10/1997 | Hudziak et al. | |
| 5,693,761 A | 12/1997 | Queen et al. | |
| 5,693,762 A | 12/1997 | Queen et al. | |
| 5,703,080 A | 12/1997 | Nakakura et al. | |

(Continued)

FOREIGN PATENT DOCUMENTS

| | | |
|---|---|---|
| EP | 0425235 A2 | 5/1991 |
| EP | 1752471 A1 | 2/2007 |

(Continued)

OTHER PUBLICATIONS

"Polythene Glycol and Derivatives for Advanced PEGylation", Catalog 2005-2006, Nektar Therapeutics.

(Continued)

*Primary Examiner* — Mark Halvorson
(74) *Attorney, Agent, or Firm* — Robin M. Silva; Louis T. Nguyen; Morgan, Lewis & Bockius, LLP

(57) ABSTRACT

The invention provides novel heterodimeric proteins including heterodimeric antibodies.

20 Claims, 161 Drawing Sheets

Specification includes a Sequence Listing.

(56) References Cited

U.S. PATENT DOCUMENTS

| | | |
|---|---|---|
| 5,712,374 A | 1/1998 | Kuntsmann et al. |
| 5,714,586 A | 2/1998 | Kunstmann et al. |
| 5,726,044 A | 3/1998 | Lo et al. |
| 5,731,168 A | 3/1998 | Carter et al. |
| 5,736,137 A | 4/1998 | Anderson et al. |
| 5,739,116 A | 4/1998 | Hamann et al. |
| 5,767,237 A | 6/1998 | Sakakibara et al. |
| 5,767,285 A | 6/1998 | Hamann et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |
| 5,807,706 A | 9/1998 | Carter et al. |
| 5,821,333 A | 10/1998 | Carter et al. |
| 5,821,337 A | 10/1998 | Carter et al. |
| 5,824,805 A | 10/1998 | King et al. |
| 5,846,545 A | 12/1998 | Chari et al. |
| 5,859,205 A | 1/1999 | Adair et al. |
| 5,877,291 A | 3/1999 | Mezes et al. |
| 5,877,296 A | 3/1999 | Hamann et al. |
| 5,891,996 A | 4/1999 | Mateo de Acosta del Rio et al. |
| 5,892,020 A | 4/1999 | Mezes et al. |
| 5,945,311 A | 8/1999 | Lindhofer et al. |
| 5,968,509 A | 10/1999 | Gorman et al. |
| 6,054,297 A | 4/2000 | Carter et al. |
| 6,071,515 A | 6/2000 | Mezes et al. |
| 6,124,431 A | 9/2000 | Sakakibara et al. |
| 6,180,370 B1 | 1/2001 | Queen et al. |
| 6,214,345 B1 | 4/2001 | Firestone et al. |
| 6,235,883 B1 | 5/2001 | Jakobovits et al. |
| 6,329,507 B1 | 12/2001 | Mezes et al. |
| 6,407,213 B1 | 6/2002 | Carter et al. |
| 6,441,163 B1 | 8/2002 | Chari et al. |
| 6,455,677 B1 | 9/2002 | Park et al. |
| 6,506,883 B2 | 1/2003 | Meteo de Acosta del Rio et al. |
| 6,602,684 B1 | 8/2003 | Umana et al. |
| 6,632,927 B2 | 10/2003 | Adair et al. |
| 6,706,265 B1 | 3/2004 | Bolt et al. |
| 6,716,410 B1 | 4/2004 | Witztum et al. |
| 6,723,538 B2 | 4/2004 | Mack et al. |
| 6,884,869 B2 | 4/2005 | Senter et al. |
| 6,989,452 B2 | 1/2006 | Ng et al. |
| 7,087,600 B2 | 8/2006 | Ng et al. |
| 7,112,324 B1 | 9/2006 | Dorken et al. |
| 7,129,261 B2 | 10/2006 | Ng et al. |
| 7,276,497 B2 | 10/2007 | Chari et al. |
| 7,303,749 B1 | 12/2007 | Chari |
| 7,368,565 B2 | 5/2008 | Chari et al. |
| 7,498,302 B2 | 3/2009 | Ng et al. |
| 7,507,420 B2 | 3/2009 | Ng et al. |
| 7,517,903 B2 | 4/2009 | Chen et al. |
| 7,601,354 B2 | 10/2009 | Chari |
| 7,642,228 B2 | 1/2010 | Carter et al. |
| 7,691,962 B2 | 4/2010 | Boyd et al. |
| 7,695,936 B2 | 4/2010 | Carter et al. |
| 7,696,338 B2 | 4/2010 | Neville, Jr. et al. |
| 7,728,114 B2 | 6/2010 | Mach et al. |
| 8,063,187 B2 | 11/2011 | Chu et al. |
| 8,114,967 B2 | 2/2012 | Bhatt et al. |
| 8,216,805 B2 | 7/2012 | Carter et al. |
| 8,236,308 B2 | 8/2012 | Kischel et al. |
| 8,309,690 B2 | 11/2012 | Allan et al. |
| 8,367,805 B2 | 2/2013 | Chamberlain et al. |
| 8,409,568 B2 | 4/2013 | Gao et al. |
| 8,592,562 B2 | 11/2013 | Kannan et al. |
| 8,637,641 B2 | 1/2014 | Dahiyat et al. |
| 8,946,387 B2 | 2/2015 | Koenig et al. |
| 10,526,417 B2 * | 1/2020 | Bernett .................. C07K 16/18 |
| 2001/0035606 A1 | 11/2001 | Schoen |
| 2002/0076406 A1 | 6/2002 | Leung |
| 2002/0103345 A1 | 8/2002 | Zhu |
| 2002/0131968 A1 | 9/2002 | Waldmann et al. |
| 2003/0003097 A1 | 1/2003 | Reff et al. |
| 2003/0015108 A1 | 1/2003 | Sappal et al. |
| 2003/0017979 A1 | 1/2003 | Mack et al. |
| 2003/0091561 A1 | 5/2003 | van de Winkel et al. |
| 2003/0223999 A1 | 12/2003 | Lindhofer |
| 2004/0071696 A1 | 4/2004 | Adams et al. |
| 2004/0162411 A1 | 8/2004 | Lanzavecchia |
| 2004/0170626 A1 | 9/2004 | Schuurman et al. |
| 2004/0242851 A1 | 12/2004 | Zhu |
| 2005/0114037 A1 | 5/2005 | Desjarlais et al. |
| 2005/0136050 A1 | 6/2005 | Kufer et al. |
| 2005/0142133 A1 | 6/2005 | Lazar et al. |
| 2005/0176028 A1 | 8/2005 | Hofmeister et al. |
| 2005/0191702 A1 | 9/2005 | Mack et al. |
| 2005/0238648 A1 | 10/2005 | Jacobs et al. |
| 2005/0238649 A1 | 10/2005 | Doronina et al. |
| 2006/0008883 A1 | 1/2006 | Lazar et al. |
| 2006/0018897 A1 | 1/2006 | Lee et al. |
| 2006/0024298 A1 | 2/2006 | Lazar et al. |
| 2006/0024317 A1 | 2/2006 | Boyd et al. |
| 2006/0073142 A1 | 4/2006 | Chan et al. |
| 2006/0074008 A1 | 4/2006 | Senter et al. |
| 2006/0115481 A1 | 6/2006 | Lindhofer et al. |
| 2006/0121032 A1 | 6/2006 | Dahiyat et al. |
| 2006/0134105 A1 | 6/2006 | Lazar et al. |
| 2006/0235208 A1 | 10/2006 | Lazar et al. |
| 2007/0071675 A1 | 3/2007 | Wu et al. |
| 2007/0105199 A1 | 5/2007 | Yan et al. |
| 2007/0123479 A1 | 5/2007 | Kufer et al. |
| 2007/0148170 A1 | 6/2007 | Desjarlais et al. |
| 2007/0287170 A1 | 12/2007 | Davis et al. |
| 2008/0044413 A1 | 2/2008 | Hammond et al. |
| 2008/0050370 A1 | 2/2008 | Glaser et al. |
| 2008/0138335 A1 | 6/2008 | Takahashi et al. |
| 2008/0213273 A1 | 9/2008 | Burge |
| 2008/0219974 A1 | 9/2008 | Bernett et al. |
| 2008/0242845 A1 | 10/2008 | Lazar et al. |
| 2009/0082213 A1 | 3/2009 | Horowitz et al. |
| 2009/0163699 A1 | 6/2009 | Chamberlain et al. |
| 2009/0214539 A1 | 8/2009 | Grosmaire et al. |
| 2009/0252683 A1 | 10/2009 | Kischel et al. |
| 2009/0252729 A1 | 10/2009 | Farrington et al. |
| 2009/0274692 A1 | 11/2009 | Tan et al. |
| 2009/0311253 A1 | 12/2009 | Ghayur et al. |
| 2009/0317869 A1 | 12/2009 | Alley et al. |
| 2010/0015133 A1 | 1/2010 | Igawa et al. |
| 2010/0080814 A1 | 4/2010 | Desjarlais et al. |
| 2010/0150918 A1 | 6/2010 | Kufer et al. |
| 2010/0174053 A1 | 7/2010 | Johnson et al. |
| 2010/0178298 A1 | 7/2010 | Lindhofer |
| 2010/0183554 A1 | 7/2010 | Mach et al. |
| 2010/0226925 A1 | 9/2010 | Dillon et al. |
| 2010/0239567 A1 | 9/2010 | Esue |
| 2010/0239582 A1 | 9/2010 | Humphreys et al. |
| 2010/0256339 A1 | 10/2010 | Bossenmaier et al. |
| 2010/0256340 A1 | 10/2010 | Brinkmann et al. |
| 2010/0298542 A1 | 11/2010 | Igawa et al. |
| 2010/0322933 A1 | 12/2010 | Lindhofer et al. |
| 2010/0330089 A1 | 12/2010 | Damle et al. |
| 2010/0331527 A1 | 12/2010 | Davis et al. |
| 2011/0054151 A1 | 3/2011 | Lazar et al. |
| 2011/0076275 A1 | 3/2011 | Igawa et al. |
| 2011/0177500 A1 | 7/2011 | Winther et al. |
| 2011/0189178 A1 | 8/2011 | Desjarlais et al. |
| 2011/0189209 A1 | 8/2011 | Neville, Jr. et al. |
| 2011/0201032 A1 | 8/2011 | Zeng et al. |
| 2011/0217302 A1 | 9/2011 | Odegard et al. |
| 2011/0262439 A1 | 10/2011 | Kufer et al. |
| 2011/0275787 A1 | 11/2011 | Kufer et al. |
| 2011/0293619 A1 | 12/2011 | Kufer et al. |
| 2012/0028304 A1 | 2/2012 | Dahiyat et al. |
| 2012/0034228 A1 | 2/2012 | Kufer et al. |
| 2012/0149876 A1 | 6/2012 | Von Kreudenstein et al. |
| 2012/0156207 A1 | 6/2012 | Chu et al. |
| 2012/0251531 A1 | 10/2012 | Baehner et al. |
| 2012/0251541 A1 | 10/2012 | Baurin et al. |
| 2013/0089541 A1 | 4/2013 | D'Angelo et al. |
| 2013/0095097 A1 | 4/2013 | Blankenship et al. |
| 2013/0101586 A1 | 4/2013 | Riegler et al. |
| 2013/0115208 A1 | 5/2013 | Ho et al. |
| 2013/0129723 A1 | 5/2013 | Blankenship et al. |
| 2013/0142793 A1 | 6/2013 | Ledbetter et al. |

(56) References Cited

U.S. PATENT DOCUMENTS

| | | |
|---|---|---|
| 2013/0171095 A1 | 7/2013 | Bernett et al. |
| 2013/0195849 A1 | 8/2013 | Spreter Von Kreudenstein et al. |
| 2013/0209355 A1 | 8/2013 | De Weers et al. |
| 2013/0336981 A1 | 12/2013 | de Kruif et al. |
| 2014/0024111 A1 | 1/2014 | Kannan et al. |
| 2014/0072581 A1 | 3/2014 | Dixit et al. |
| 2014/0086916 A1 | 3/2014 | Zha |
| 2014/0212435 A1 | 7/2014 | Moore et al. |
| 2014/0212436 A1 | 7/2014 | Moore et al. |
| 2014/0249297 A1 | 9/2014 | Lazar et al. |
| 2014/0288275 A1 | 9/2014 | Moore et al. |
| 2014/0294759 A1 | 10/2014 | Chu et al. |
| 2014/0294823 A1 | 10/2014 | Moore et al. |
| 2014/0294833 A1 | 10/2014 | Desjarlais et al. |
| 2014/0294835 A1 | 10/2014 | Moore et al. |
| 2014/0294836 A1 | 10/2014 | Chu et al. |
| 2014/0302064 A1 | 10/2014 | Moore |
| 2014/0322217 A1 | 10/2014 | Moore et al. |
| 2014/0356381 A1 | 12/2014 | Moore et al. |
| 2014/0363426 A1 | 12/2014 | Moore et al. |
| 2014/0370013 A1 | 12/2014 | Desjarlais et al. |
| 2014/0370020 A1 | 12/2014 | Kuramochi et al. |
| 2014/0377269 A1 | 12/2014 | Mabry et al. |
| 2014/0377270 A1 | 12/2014 | Moore et al. |
| 2015/0071948 A1 | 3/2015 | Lazar et al. |
| 2015/0239991 A1 | 8/2015 | Blein et al. |
| 2015/0284475 A1 | 10/2015 | Zhou et al. |
| 2015/0307629 A1 | 10/2015 | Bernett et al. |
| 2016/0060360 A1 | 3/2016 | Moore et al. |
| 2016/0068588 A1 | 3/2016 | Bernett et al. |
| 2016/0176969 A1 | 6/2016 | Bernett et al. |
| 2016/0215063 A1 | 7/2016 | Bernett et al. |
| 2016/0229924 A1 | 8/2016 | Bernett et al. |
| 2016/0355608 A1* | 12/2016 | Bernett .............. C07K 16/2809 |
| 2018/0305465 A1* | 10/2018 | Stevens ................ C07K 16/468 |

FOREIGN PATENT DOCUMENTS

| | | |
|---|---|---|
| EP | 1829895 A1 | 9/2007 |
| EP | 2006381 A1 | 12/2008 |
| EP | 2009101 A4 | 10/2009 |
| EP | 2202245 A1 | 6/2010 |
| EP | 2194066 A4 | 12/2010 |
| EP | 2155788 B1 | 6/2012 |
| EP | 2522724 A1 | 11/2012 |
| WO | WO-1987/005330 A1 | 9/1987 |
| WO | WO-1992/011018 A1 | 7/1992 |
| WO | WO-1993/021232 A1 | 10/1993 |
| WO | WO-1994/013804 A1 | 6/1994 |
| WO | WO-1995/020045 A1 | 7/1995 |
| WO | WO-1996/027011 A1 | 9/1996 |
| WO | WO-1996/040210 A1 | 12/1996 |
| WO | WO-1998/050431 A2 | 11/1998 |
| WO | WO-1999/37791 A1 | 7/1999 |
| WO | WO-1999/054440 A1 | 10/1999 |
| WO | WO-1999/066951 A2 | 12/1999 |
| WO | WO-2000/061739 A1 | 10/2000 |
| WO | WO-2001/024763 A2 | 4/2001 |
| WO | WO-2001/029246 A1 | 4/2001 |
| WO | WO-2001/062931 A2 | 8/2001 |
| WO | WO-2001/083525 A2 | 11/2001 |
| WO | WO-2001/088138 A1 | 11/2001 |
| WO | WO-2001/090192 A2 | 11/2001 |
| WO | WO-2002/016368 A1 | 2/2002 |
| WO | WO-2002/030954 A1 | 4/2002 |
| WO | WO-2002/031140 A1 | 4/2002 |
| WO | WO-2002/062850 A2 | 8/2002 |
| WO | WO-2002/083180 A1 | 10/2002 |
| WO | WO-2002/088172 A2 | 11/2002 |
| WO | WO-2002/098883 A1 | 12/2002 |
| WO | WO-2004/010957 A2 | 2/2004 |
| WO | WO-2004/043493 A1 | 5/2004 |
| WO | WO-2004/103272 A2 | 12/2004 |
| WO | WO-2004/106383 A1 | 12/2004 |
| WO | WO-2005/063816 A3 | 8/2005 |
| WO | WO-2005/112919 A2 | 12/2005 |
| WO | WO-2005/118635 A2 | 12/2005 |
| WO | WO-2006/020258 A2 | 2/2006 |
| WO | WO-2006/034488 A2 | 3/2006 |
| WO | WO-2006/036834 A2 | 4/2006 |
| WO | WO-2006/072620 A1 | 7/2006 |
| WO | WO-2006/106905 A1 | 10/2006 |
| WO | WO-2006/110476 A2 | 10/2006 |
| WO | WO-2007/005612 A2 | 1/2007 |
| WO | WO-2007/018431 A2 | 2/2007 |
| WO | WO-2007/042261 A2 | 4/2007 |
| WO | WO-2007/042309 A2 | 4/2007 |
| WO | WO-2007/047829 A2 | 4/2007 |
| WO | WO-2007/059404 A2 | 5/2007 |
| WO | WO-2007/062037 A2 | 5/2007 |
| WO | WO-2007/089149 A2 | 8/2007 |
| WO | WO-2007/093630 A1 | 8/2007 |
| WO | WO-2007/098934 A1 | 9/2007 |
| WO | WO-2007/110205 A2 | 10/2007 |
| WO | WO-2007/113648 A2 | 10/2007 |
| WO | WO-2007/147901 A1 | 12/2007 |
| WO | WO-2008/003103 A2 | 1/2008 |
| WO | WO-2008/003115 A1 | 1/2008 |
| WO | WO-2008/003116 A2 | 1/2008 |
| WO | WO-2008/119096 A1 | 10/2008 |
| WO | WO-2008/119566 A2 | 10/2008 |
| WO | WO-2008/124858 A2 | 10/2008 |
| WO | WO-2008/145142 A1 | 12/2008 |
| WO | WO-2008/150494 A1 | 12/2008 |
| WO | WO-2009/000006 A1 | 12/2008 |
| WO | WO-2009/017394 A1 | 2/2009 |
| WO | WO-2009/017823 A2 | 2/2009 |
| WO | WO-2009/030734 A1 | 3/2009 |
| WO | WO-2009/032782 A2 | 3/2009 |
| WO | WO-2009/086320 A1 | 7/2009 |
| WO | WO-2009/089004 A1 | 7/2009 |
| WO | WO-2009/106096 A1 | 9/2009 |
| WO | WO-2009/106321 A1 | 9/2009 |
| WO | WO-2010/028796 A1 | 3/2010 |
| WO | WO-2010/033736 A1 | 3/2010 |
| WO | WO-2010/034441 A1 | 4/2010 |
| WO | WO-2010/037835 A2 | 4/2010 |
| WO | WO-2010/042904 A2 | 4/2010 |
| WO | WO-2010/062171 A2 | 6/2010 |
| WO | WO-2010/085682 A2 | 7/2010 |
| WO | WO-2010/106180 A2 | 9/2010 |
| WO | WO-2010/112193 A1 | 10/2010 |
| WO | WO-2010/115551 A1 | 10/2010 |
| WO | WO-2010/115552 A1 | 10/2010 |
| WO | WO-2010/115553 A1 | 10/2010 |
| WO | WO-2010/115589 A1 | 10/2010 |
| WO | WO-2010/119119 A1 | 10/2010 |
| WO | WO-2010/151792 A1 | 12/2010 |
| WO | WO-2010/151808 A1 | 12/2010 |
| WO | WO-2011/005621 A1 | 1/2011 |
| WO | WO-2011/028952 A1 | 3/2011 |
| WO | WO-2011/036183 A2 | 3/2011 |
| WO | WO-2011/063348 A1 | 5/2011 |
| WO | WO-2011/066342 A2 | 6/2011 |
| WO | WO-2011/066501 A1 | 6/2011 |
| WO | WO-2011/131746 A2 | 10/2011 |
| WO | WO-2011/133886 A2 | 10/2011 |
| WO | WO-2011/143545 A1 | 11/2011 |
| WO | WO-2011/154453 A1 | 12/2011 |
| WO | WO-2012/016227 A2 | 2/2012 |
| WO | WO-2012/018687 A1 | 2/2012 |
| WO | WO-2012/032080 A1 | 3/2012 |
| WO | WO-2012/058768 A1 | 5/2012 |
| WO | WO-2012/107417 A1 | 8/2012 |
| WO | WO-2012/116453 A1 | 9/2012 |
| WO | WO-2012/125850 A1 | 9/2012 |
| WO | WO-2012/131555 A2 | 10/2012 |
| WO | WO-2012/146628 A1 | 11/2012 |
| WO | WO-2012/162067 A2 | 11/2012 |
| WO | WO-2013/016714 A1 | 1/2013 |
| WO | WO-2013/022855 A1 | 2/2013 |
| WO | WO-2013/026833 A1 | 2/2013 |
| WO | WO-2013/033008 A2 | 3/2013 |
| WO | WO-2013/047748 A1 | 4/2013 |

(56) References Cited

FOREIGN PATENT DOCUMENTS

| | | |
|---|---|---|
| WO | WO-2013/055809 A1 | 4/2013 |
| WO | WO-2013/059885 A2 | 5/2013 |
| WO | WO-2013/063702 A1 | 5/2013 |
| WO | WO-2013/096828 A1 | 6/2013 |
| WO | WO-2013/006544 A8 | 8/2013 |
| WO | WO-2013/125667 A1 | 8/2013 |
| WO | WO-2013/180201 A1 | 12/2013 |
| WO | WO-2014/004586 A1 | 1/2014 |
| WO | WO-2014/012085 A2 | 1/2014 |
| WO | WO-2012/125495 A3 | 4/2014 |
| WO | WO-2014/079000 A1 | 5/2014 |
| WO | WO-2014/110601 A1 | 7/2014 |
| WO | WO-2014/113510 A1 | 7/2014 |
| WO | WO-2014/145806 A2 | 9/2014 |
| WO | WO-2014/145907 A1 | 9/2014 |
| WO | WO-2014/164553 A1 | 10/2014 |
| WO | WO-2015/063339 A1 | 5/2015 |
| WO | WO-2015/130728 A1 | 9/2015 |
| WO | WO-2015/149077 A1 | 10/2015 |
| WO | WO-2015/184207 A1 | 12/2015 |
| WO | WO-2016/014984 A1 | 1/2016 |
| WO | WO-2016 040294 A2 | 3/2016 |
| WO | WO-2016 071355 A1 | 5/2016 |
| WO | WO-2016/086186 A2 | 6/2016 |
| WO | WO-2016/086189 A2 | 6/2016 |
| WO | WO-2016/086196 A2 | 6/2016 |
| WO | WO-2016/105450 A2 | 6/2016 |
| WO | WO-2016/141387 A1 | 9/2016 |
| WO | WO-2016/182751 A1 | 11/2016 |
| WO | WO-2016/210223 A1 | 12/2016 |

OTHER PUBLICATIONS

"Xencor Provides Data Updates on XmaB Bispecific Antibody Program and Announces Presentations at Upcoming American Society of Hematology 2014 Annual Meeting", Nov. 6, 2014, XP055255549, retrieved from the internet: <http://files.shareholder.conn/downloads/AMDA-2B2V8N/Ox0x792404/77590b72-837a-4085-bc55-78fa500638dc/XNCR_News_2014_11_6_General_Releases.pdf>.
Abbott Laboratories, Strategies and Current Approaches for Improving Drug-Like-Properties During Biologics Drug Candidate Selection, AAPS Webinar—Nov. 10, 2011.
Adams et al., Avidity-Mediated Enhancement of In vivo Tumor Targeting by Single-Chain Fv Dimers, *Clin Cancer Res*, 2(5):1599-605 (2006).
Alberola-Ila et al., Stimulation Through the TCR/CD3 Complex Up-Regulates the CD2 Srface Expression on Human T Lymphocytes, 02-15 (1991).
Alibaud et al., A New Monoclonal Anti-CD3? Antibody Reactive on Paraffin Sections, *Journal of Histochemistry & Cytochemistry*, 48:1609 (2000).
An et al., IgG2m4, an engineered antibody isotype with reduced Fc function, mAbs, 1(6):572-9 (2009).www.landesbioscience.com/journals/mabs/article/10185.
Aplin et al., Preparation, properties, and applications of carbohydrate conjugates of proteins and lipids, CRC Crit. *Rev. Biochem.*, 259-306 (1981).
Arnett et al., Crystal structure of a human CD3-E/05 dimer in complex with a UCHT1 single-chain antibody fragment, *PNAS*, 101(46):16268-73 (2004).
Asano et al., Cytotoxic enhancement of a bispecific diabody (Db) by format conversion to tandem single-chain variable fragment (taFv): The Case of the hEx3 Diabody, JBC Papers in Press, (2010). http://www.jbc.org/cgi/doi/10.1074/jbc.M110.172957.
Asano et al., Highly Effective Recombinant Format of a Humanized IgG-like Bispecific Antibody for Cancer Immunotherapy with Retargeting of Lymphocytes to Tumor Cells, *The Journal of Biological Chemistry*, 282(38):27659-65 (2007).

Atwell et al., Stable Heterodimers from Remodeling the Domain Interface of a Homodimer using a Phage Display Library, *J. Mol. Biol.*, 270:26-35 (1997).
Baca et al., Antibody humanization using monovalent phage display., *J. Biol. Chem.*, 272(16):10678-84 (1997).
Baeuerle et al., Response to Letter, "Correct TandAb protein," *Molecular Immunology*, 44:3084 (2007).
Baeuerle et al., Review—Bispecific T-Cell Engaging Antibodies for Cancer Therapy, *Cancer Res*, 69(12): 4941-44 (2009).
Barbas et al. In vitro evolution of a neutralizing human antibody to human immunodeficiency virus type 1 to enhance affinity and broaden strain cross-reactivity, *Proc. Nat. Acad. Sci. USA*, 91:3809-13 (1994).
Bargou et al., Tumor regression in cancer patients by very low doses of a T cell-engaging antibody, *Science*, 321:974-7 (2008).
Bhatt, Sea Lane—DDD presentation, "Surrobodies TM—A Novel Approach to Bispecifics . . . ," Aug. 8, 2012.
Bibollet-Ruche et al., The Quality of Chimpanzee T-Cell Activation and Simian Immunodeficiency Virus/Human Immunodeficiency Virus Susceptibility Achieved via Antibody-Mediated T-Cell Receptor/CD3 stimulation is a function of the anti-CD3 antibody isotype, *J. Virol.*, 82(20):10271-8 (2008).
Biochemica, Your apoptosis specialist, 2:34-37 (1999).
Bird et al., Single-chain antigen-binding proteins, *Science*, 242:423-6 (1988).
Bluemel et al., Epitope distance to the target cell membrane and antigen size determine the potency of T cell-mediated lysis by BiTE antibodies specific for a large melanoma surface antigen, *Cancer Immunol. Immunother.*, 59(8):1197-209 (2010).
Borras et al., Generic Approach for the Generation of Stable Humanized Single-chain Fv Fragments from Rabbit Monoclonal Antibodies, *J. Biol. Chem.*, 285(12):9054-66 (2010).
Bortoletto et al., Optomizing anti-CD3 affinity for effective T cell targeting against tumor cells, *Eur J Immunol.*, 32(11):3102-7 (2002).
Boswell et al., Effects of Charge on Antibody Tissue Distribution and Pharmacokinetics, Bioconjugate Chem., 21(21):2153-2163 (2010).
Brandt et al., Bispecific antibody fragments with CD20 3 CD28 specificity allow effective autologous and allogeneic T-cell activation against malignant cells in peripheral blood and bone marrow cultures from patients with B-cell lineage leukemia and lymphoma, *Experimental Hematology*, 27:1264-70 (1999).
Brinkmann et al., A recombinant immunotoxin containing a disulfide-stabilized Fv fragment, *Proc. Natl. Acad. Sci. USA*, 90: 7538-42 (1993).
Brinkmann et al., presentation slideshow—"Roche Penzberg & Roche Glycart, Schlieren: Centers of Excellence for Recombinant Proteins".
Cao et al., Oligomerization is required for the activity of recombinant soluble LOX-1., *FEBS J.*, 276(17):4909-20 (2009).
Carpenter et al., Non-Fc Receptor-Binding Humanized Anti-CD3 Antibodies Induce Apoptosis of Activated Human T Cells, *J. Immunol.*, 165(11):6205-13 (2000).
Carter et al., Antibody-drug conjugates for cancer therapy, *Cancer J.*, 14(3):154-169 (2008).
Carter et al., Humanization of an anti-p185HER2 antibody for human cancer therapy, *Proc. Natl. Acad. Sci. USA*. 89:4285-9 (1992).
Castoldi et al.,Molecular characterization of novel trispecific ErbB-cMet-!GPI R antibodies and their antigen-binding properties, *Protein Engineering. Design & Selection*, 25(10):551-9 (2012).
Cemerski et al., Suppression of mast cell degranulation through a dual-targeting tandem IgE-IgG Fc domain biologic engineered to bind with high affinity to FcyRIIb., *Immunol Lett.*, 143(1):34-43 (2012).
Chames et al., Bispecific antibodies for cancer therapy—The light at the end of the tunnel?, *mAbs*, 1(6):1-9 (2009).
Chang et al., Monoclonal antibodies against oxidized low-density lipoprotein bind to apoptotic cells and inhibit their phagocytosis by elicited macrophages: evidence that oxidation-specific epitopes mediate macrophage recognition., *Proc. Natl. Acad. Sci. USA*, 96(11):6353-8 (1999).
Chari et al., Immunoconjugates containing novel maytansinoids: promising anticancer drugs, *Cancer Research*, 52:127-31 (1992).

(56) References Cited

OTHER PUBLICATIONS

Chatal, Monoclonal Antibodies in Immunoscintigraphy, CRC Press Book Abstract (1989).
Chelius et al., Structural and functional characterization of the trifunctional antibody catumaxomab, mAbs, 2(3):309-19 (2010).
Chothia et al., Canonical structures for the hypervariable regions of immunoglobulins, J. Mol. Biol., 196:901-17 (1987).
Chothia et al., Structural Determinants in the Sequences of Immunoglobulin Variable Domain, J. Mol. Biol., 278:457-79 (1998).
Chu et al., Inhibition of B cell receptor-mediated activation of primary human B cells by coengagement of CD19 and FcgammaRIIb with Fc-engineered antibodies, Mol Immunol., 45(15):3926-33 (2008).
Chu et al., Reduction of total IgE by targeted coengagement of IgE B-cell receptor and FcyRIIb with Fc-engineered antibody, J. Allergy Clin. Immunol.,129(4):1102-15 (2012).
Conrad et al., TCR and CD3 Antibody Cross-Reactivity in 44 Species, Cytometry Part A, 71A:925-33 (2007).
Conrath et al., Antigen Binding and Solubility Effects upon the Veneering of a Camel VHH in Framework-2 to Mimic a VH, J. Mol. Biol., 350:112-25 (2005).
Counterman et al., Volumes of Individual Amino Acid Residues in Gas-Phase Peptide Ions, J. Am. Chem. Soc., 121 (16):4031-9 (1999).
Cuesta et al., Multivalent antibodies: when design surpasses evolution, Trends in Biotechnology, 28(7):355-62 (2010).
D'Argouges et al., Combination of rituximab with blinatumomab (MT103/MEDI-538), a T cell-engaging CD19-/CD3-bispecific antibody, for highly efficient lysis of human B lymphoma cells, Leukemia Research, 33:465-73 (2009).
Davies et al., Expression of GnTIII in recombinant anti-CD20 CHO production cell line: expression of antibodies with altered glycoforms leads to an increase in ADCC through higher affinity for FCyRIII, Biotechnol. Bioeng., 74:288-94 (2001).
Davila et al., Efficacy and Toxicity Management of 19-28z CART Cell Therapy in B Cell Acute Lymphoblastic Leukemia, Sci. Trans. Med., 6(224):1-10, 224ra25 (2014).
Davis et al., SEEDbodies: fusion proteins based on strand-exchange engineered domain (SEED) CH3 heterodimers in an Fc analogue platform for asymmetric binders or immunofusions and bispecific antibodies, Protein Engineering, Design & Selection, 23(4):195-202 (2010).
De Groot et al., De-Immunization of Therapeutic Proteins by T-Cell Epitope Modification, Dev. In Biologicals, 122:171-194 (2005).
De Pascales et al., Grafting of "abbreviated" complementarity-determining regions containing specificity-determining residues essential for ligand contact to engineer a less immunogenic humanized monoclonal antibody, J. Immunol., 169:3076-84 (2002).
Del Nagro et al., A critical role for complement C3d and the B cell coreceptor (CD19/CD21) complex in the initiation of inflammatory arthritis., J. Immunol.,175(8):5379-89 (2005).
Demarest et al., Antibody therapeutics, antibody engineering, and the merits of protein stability, Current Opinin in Drug Discovery & Development, 11(5):675-87 (2008).
Deyev et al., Multivalency: the hallmark of antibodies used for optimization of tumor targeting by design, BioEssays, 30:904-18 (2008).
DiGiammarino et al., Ligand association rates to the inner-variable-domain of a dual-variable-domain immunoglobulin are significantly impacted by linker design, mAbs, 3(5):487-94 (2011).
Dixon et al., Activation of Human T Lymphocytes by Crosslinking of Anti-CD3 Monoclonal Antibodies, J. Leuk. Biol., 46:214-20 (1989).
Dong et al., A stable IgG-like bispecific antibody targeting the epidermal growth factor receptor and the type I insulin-like growth factor receptor demonstrates superior anti-tumor activity, mAbs, 3(3):273-88 (2011).
Doronina, Development of potent monoclonal antibody auristatin conjugates for cancer therapy, Nat. Biotechnol., 21(7):778-84 (2003).
Dreier et al., Extremely Potent, Rapid and Costimulation-Independent Cytotoxic T-cell Response Against Lymphoma Cells Catalyzed by a Single-Chain Bispecific Antibody, Int. J. Cancer, 100:690-7 (2002).
Dreier et al., T Cell Costimullndependent and Very Efficacious Inhibition of Tumor Growth in Mice Bearing Subcutaneous or Leukemic Human B Cell Lymphoma Xenografts by a CD19-/CD3-Bispecific Single-Chain Antibody Construct, J. ImmunoL, 170:4397-402 (2003).
Dubowchick et al., Receptor-mediated and enzyme-dependent targeting of cytotoxic anticancer drugs, Pharm. Therapeutics, 83:67-123 (1999).
Ducry et al.,Antibody-drug conjugates: linking cytotoxic payloads to monoclonal antibodies, Bioconjugate Chem., 21:5-13 (2010).
Dudgeon et al., General strategy for the generation of human antibody variable domains with increased aggregation resistance, Pnas Early Edition, 10879-84 (2012).
Duke et al., Measurement of apoptosis and other forms of cell death, Curr protocols Immuno/., 3.17.1-3.17.16 (2004).
Duksin et al., Relationship of the structure and biological activity of the natural homologues of tunicamycin, J. Biol. Chem., 257:3105 (1982).
Duval et al., a Bispecific Antibody Composed of a Nonneutralizing Antibody to the gp41 Immunodominant Region and an Anti-CD89 Antibody Directs Broad Human Immunodeficiency Virus Destruction by Neutrophils, J. Virol., 4671-4 (2008).
Edge et al., Deglycosylation of glycoproteins by trifluoromethanesulfonic acid, Anal. Biochem., 118:131 (1981).
Elliott et al., Antiparallel Conformation of Knob and Hole Aglycosylated Half-Antibody Homodimers Is Mediated by a CH2-CH3 Hydrophobic Interaction, J. Molec. Biol., 426(9):1947-57 (2014).
Feldmann et al., Novel Humanized and Highly Efficient Bispecific Antibodies Mediate Killing of Prostate Stem Cell Antigen-Expressing Tumor Cells by CD8+ and CD4+ T cells, Oncotarget, 189(6):3249-59 (2012).
Feldmann et al., Retargeting of T Cells to Prostate Stem Cell Antigen Expressing Tumor Cells: Comparison of Different Antibody Formats, Onco target, 8(19):31368-85 (2017).
Fernandes et al., T Cell Receptors are Structures Capable of Initiating Signaling in the Absence of Large Conformational Rearrangements, J. Biol. Chem., 287(16):13324-35 (2012).
Fischer et al., Bispecifc antibodies: molecules that enable novel therapeutic strategies, 74:3-14 (2007).
Foreman et al., ErbB3 Inhibitory Surrobodies Inhibit Tumor Cell Proliferation in Vitro and in Vivo, Mol. Cancer. Ther., 11(7) : 1411-1420 (2012).
Foreman et al., PEGS poster, ErbB3 Inhibitory Surrobodies Inhibit Tumor Cell Proliferation In Vitro and In Vivo, Mol. Can. Ther., 11(7):1411-20 (2012).
Fraker et al., Crystal structure of peptide cyclo-(D-VAL-L-PRO-L-VAL-D-PRO)3, Biochem. Biophys. Res. Commun., 80(4):849-57 (1978).
Francois et al., Construction of a Bispecific Antibody Reacting with the a-and R-Chains of the Human IL-2 Receptor, J. Immunol., 150(10): 4610-9 (1993).
F-star Modular Antibodies Fact Sheet, "Modular Antibody Technology" (w/ reference to Ruker WO 2006/072620 AI) Apr. 2008.
F-star Modular Antibodies Press Release, "Antibody Engineering Company F-Star Buys Back Royalty Obligations. TVM Capital Joins Investor Syndicate." Mar. 28, 2008.
Fudenberg et al., Serologic Demonstration of Dual Specificity of Rabbit Bivalent Hybrid Antibody, J. Experimental Med., 119(1):151-66 (1964).
Ganesan et al., FcyRIIb on Liver Sinusoidal Endothelium Clears Small Immune Complexes., J. Immunol., 189(10):4981-88 (2012).
GenBank Accession No. AAA38124.1, immunoglobulin heavy-chain VJ region [Mus musculus],dated Apr. 27, 1993.
GenBank Accession No. AAA39180.1, immunoglobulin light-chain VJ region [Mus musculus], dated Apr. 27, 1993.
Ghendler et al., One of the CD3E Subunits within a T Cell Receptor Complex Lies in Close Proximity to the CR FG Loop, J. Exp. Med., 187(9):1529-36 (1998).

(56) References Cited

OTHER PUBLICATIONS

Ghetie et al., Multiple roles for the major histocompatibility complex Class I-related receptor FcRn, *Annu. Rev. Immunol.*, 18:739-66 (2000).
Gilliland et al., Universal bispecific antibody for targeting tumor cells for destruction by cytotoxic T cells, *Proc. Natl. Acad. Sci. USA*, 85:7719-23 (1988).
Gorman et al., Reshaping a therapeutic CD4 antibody, *Proc. Natl. Acad. Sci. USA*, 88:4181-4185 (1991).
Grodzki et al., Antibody Purification: Ion-Exchange Chromatography, *Methods. Mol. Biol.*, 588:27-32. (2010).
Gunasekaran et al., Enhancing Antibody Fc Heterodimer Formation through Electrostatic Steering Effects, *J. Biol. Chem.*, 285(25):19637-46 (2010).
Haagen et al., The Efficacy of CD3 x CD19 Bispecific Monoclonal Antibody (BsAb) in a Clonogenic Assay: The Effect of Repeated Addition of BsAb, and Interleukin-2, *Blood*, 85(11):3208-12 (1995).
Hakimuddin et al., A chemical method for the deglycosylation of proteins, *Arch. Biochem. Biophys.* 259:52 (1987).
Hamel, et al., The Role of the VL- and VH-Segments in the Preferential Reassociation of Immunoglobulin Subunits, *Molecular Immunology*, 23(5):503-10 (1986).
Hawkins et al, Selection of phage antibodies by binding affinity mimicking affinity maturation, *J. Mol. Biol*, 226:889-96 (1992).
Hayden-Ledbetter, et al., CD20-Directed Small Modular Immunopharmaceutical, TRU-015, Depletes Normal and Malignant B Cells, *Clin. Cancer Res*, 15(8):2739-46 (2009).
He et al., Humanization and pharmacokinetics of a monoclonal antibody with specificity for both E-and P-selectin, *J. Immunol.*, 160:1029-35 (1998).
Hennecke et al., Non-repetitive single-chain Fv linkers selected by selectively infective phage (SIP) technology, *Protein Eng.*, 11(5):405-10 (1998).
Hernandez-Caselles, et al., A study of CD33 (SIGLEC-3) antigen expression and function on activated human T and NK cells: two isoforms of CD33 are generated by alternative splicing, *J. Leukoc. Biol.*, 79:46-58 (2006).
Hexham et al., Influence of relative binding affinity on efficacy in a panel of anti-CD3 scFv immunotoxins, *Molecular Immunology*, 38:397-408 (2001).
Hinman et al., Preparation and characterization of monoclonal antibody conjugates of the calicheamicins: a novel and potent family of antitumor antibodies, *Cancer Res.*, 53:3336-42 (1993).
Hoffmann et al Serial killing of tumor cells by cytotoxic T cells redirected with a CD19-/CD3-bispecific single-chain antibody construct, *Int. J. Cancer*, 115:98-104 (2005).
Holliger et al., "Diabodies": Small Bivalent and bispecific antibody fragments, *Proc. Natl. Acad.* Sci. U.S.A., 90:6444-8 (1993).
Holliger et al., Engineering bispecific antibodies, *Current Opinion Biotechnol.*, 4:446-9 (1993).
Houtenbos et al., The novel bispecific diabody aCD40/aCD28 strengthens leukaemic dendritic cell-induced T-cell reactivity, *Brit. J. Haematology*, 142:273-83 (2008).
Hu et al., Minibody: A novel engineered anti-carcinoembryonic antigen antibody fragment (single-chain Fv-CH3) which exhibits rapid, high-level targeting of xenografts, *Cancer Res.*, 56:3055-61 (1996).
Huston et al., Protein engineering antibody binding sites: recovery of specific activity in an anti-digoxin single-chain Fv analogue produced in *Escherichia coli, Proc. Natl. Acad. Sci. U.S.A*. 85:5879-5883 (1988).
Igawa et al., Reduced elimination of IgG antibodies by engineering the variable region, *PEDS*. 23(5): 385-392 (2010).
Ishigaki et al., Impact of Plasma Oxidized Low-Density Lipoprotein Removal on Atherosclerosis, *Circulation*, 118: 75-83 (2008).
Jackson et al., In vitro antibody maturation, *J. Immunol.* 154(7):3310-9 (1995).
Jager, et al., The Trifunctional Antibody Ertumaxomab Destroys Tumor Cells That Express Low Levels of Human Epidermal Growth Factor Receptor 2, *Cancer Res*, 69(10):4270-6 (2009).
Jefferis et al., Interaction sites on human IgG-Fc for FcγR: current models, *Immunol. Lett.*, 82:57-65 (2002).
Jespers et al., Crystal Structure of HEL4, a Soluble, Refoldable Human VH Single Domain with a Germ-line Scaffold, *J. Mol. Biol.*, 337:893-903 (2004).
Jimenez et al., A recombinant, fully human, bispecific antibody neutralizes the biological activities mediated by both vascular endothelial growth factor receptors 2 and 3, *Mol. Cancer Ther.*, 4(3):427-34 (2005).
Jin et al., The Design and Engineering of IgG-Like Bispecific Antibodies, Chapter 9, *Bispecific Antibodies*, 151-169. (2011).
Jin, et al., MetMAb, the One-Armed 5D5 Anti-c-Met Antibody, Inhibits Orthotopic Pancreatic Tumor Growth and Improves Survival, *Cancer Res*, 68:4360-8 (2008).
Johnson et al., Anti-tumor activity of CC49-doxorubicin immunoconjugates, *Anticancer Res.*, 15:1387-93 (1995).
Johnson et al., Effector cell recruitment with novel Fv-based dual-affinity re-targeting protein leads to potent tumor cytolysis and in vivo B-cell depletion, *J. Mol. Biol.*, 399:436-49 (2010).
Jones et al., Replacing the complementarity-determining regions in a human antibody with those from a mouse, *Nature*, 321:522-5 (1986).
Jordan et al., Structural understanding of stabilization patterns in engineered bispecific Ig-like antibody molecules, *Proteins*, 77:832-41 (2009).
Jung et al., Design of interchain disulfide bonds in the framework region of the Fv fragment of the monoclonal antibody B3, *Proteins*, 19(1):35-47 (1994).
Jung et al.,Target Cell-restricted Triggering of the CD95 (APO-1/Fas) Death Receptor with Bispecific Antibody Fragments, *Cancer Research*, 61:1846-8 (2001).
Jungbluth et al., A monoclonal antibody recognizing human cancers with amplification/overexpression of the human epidermal growth factor receptor, *Proc. Natl. Acad. Sci. USA*, 100(2):639-44 (2003).
Kabat et al., Sequences of proteins of immunological interest, Department of Health and Human Services, Bethesda, 1(5) (1991).
Kakutani et al., Accumulation of LOX-1 ligand in plasma and atherosclerotic lesions of Watanabe heritable hyperlipidemic rabbits: identification by a novel enzyme immunoassay, *Biochem. Biophys. Res. Commun.*, 282(1):180-5 (2001).
Kanakaraj et al., Simultaneous targeting of TNF and Ang2 with a novel bispecific antibody enhances efficacy in an in vivo model of arthritis, *mAbs*, 4(5):600-13 (2012).
Kettleborough et al., Humanization of a mouse monoclonal antibody by CDR-grafting: the importance of framework residues on loop conformation, *Protein Eng.*, 4(7):773-83 (1991).
Keyna et al., Surrogate Light Chain-Dependent Selection of Ig Heavy Chain V Regions, *J. Immunol.*, 155:5536-42 (1995).
Kiewe et al., Phase I Trial of the Trifunctional Anti-HER2 x Anti-CD3 Antibody Ertumaxomab in Metastatic Breast Cancer, *Clin. Cancer Res.*, 12(10):3085-91 (2006).
Kim et al., Localization of the site of murine IgG1 molecule that is involved in binding the murine intestinal Fc receptor, *Eur. J. Immunol.*, 24:2429-34 (1994).
Kipriyanov et al., Bispecific CD3 x CD19 Diabody for T Cell-Mediated Lysis of Malignant Human B Cells, *Int. J. Cancer*, 77:763-72 (1998).
Kipriyanov et al., Bispecific tandem diabody for tumor therapy with improved antigen binding and pharmacokinetics, *J. Mol. Biol.*, 293:41-56 (1999).
Kipriyanov et al., Effect of Domain Order on the Activity of Bacterially Produced Bispecific Single-chain Fv Antibodies, *J. Mol. Biol.*, 330:99-111 (2003).
Kipriyanov et al., Two amino acid mutations in an anti-human CD3 single chain Fv antibody fragment that affect the yield on bacterial secretion but not the affinity, *Protein Engineering*, 10(4):445-53 (1997).
Klein et al Progress in overcoming the chain association issue in bispecific heterodimeric IgG antibodies, *mAbs*, 4(6):653-63 (2012).
Klein et al., Progression of metastatic human prostate cancer to androgen independence in immunodeficient SDIC mice, *Nature Medicine*, 3:402-8 (1997).

(56) References Cited

OTHER PUBLICATIONS

Klinger et al., Immunopharmacologic response of patients with B-lineage acute lymphoblastic leukemia to continuous infusion of T cell-engaging CD19/CD3-bispecific BiTE antibody blinatumomab, *Blood*, 119(26):6226-33 (2012).
Koristka et al., Retargeting of Human Regulatory T Cells by Single-Chain Bispecific Antibodies, *J. Immunol.*, 188:1551-8 (2012).
Kostelny et al., Formation of a bispecific antibody by the use of leucine zippers, *J. Immunol.*, 148:1547-53 (1992).
Krauss et al., Specificity grafting of human antibody frameworks selected from a phage display library: generation of a highly stable humanized anti-CD22 single-chain Fv fragment, *Protein Engineering*, 16(10):753-9 (2003).
Krupka et al., CD33 target validation and sustained depletion of AML blasts in long-term cultures by the bispecific T-cell-engaging antibody AMG 330, *Blood*, 123(3):356-65 (2014).
Kung et al., Monoclonal Antibodies Defining Distinctive Human T Cell Surface Antigens, *Science*, 206:347-49 (1979).
Kuppen et al., The development and purification of a bispecific antibody for lymphokine-activated killer cell targeting against the rat colon carcinoma CC531, *Cancer Immunol. Immunother.*, 36(6):403-8 (1993).
Labrijn et al., Efficient generation of stable bispecific IgG1 by controlled Fab-arm exchange, *Proc. Nat. Acad. Sci. USA*, 110(13):5145-50 (2013).
Laszlo et al., Cellular determinants for preclinical activity of a novel CD33/CD3 bispecific T-cell engager (BiTE) antibody, AMG 330, against human AML, *Blood*, 123:554-61 (2014).
Lau et al., Conjugation of Doxorubicin to monoclonal anti-carcinoembryonic antigen antibody via novel thiol-directed cross-linking regents, *Bioorg-Med-Chem.*, 3(10):1299-304 (1995).
Lau et al., Novel doxorubicin-monoclonal anti-carcinoembryonic antigen antibody immunoconjugate activity in vitro, *Bioorg-Med-Chem.* 3(10):1305-12 (1995).
Lazar, Lazar Declaration, 1-4 Dec. 27, 2010.
Lewis et al., Generation of bispecific IgG antibodies by structure-based design of an orthogonal Fab interface, *Nature Biotechnology*, 32(2):191-8 (2014).
Igawa, $V_H/V_L$- interface engineering to promote selective expression and inhibit Conformational isomerization of thrornbopoietin receptor agonist single-chain diabody, *Protein Engineering, Design & Selection*, 23(8):667-77 (2010).
Li et al., Construction and characterization of a humanized anti-human CD3 monoclonal antibody 12F6 with effective immunoregulation functions, *Immunology*, 116:487-98 (2005).
Lindhofer, et al., Preferential Species-Restricted Heavy/Light Chain Pairing in Rat/Mouse Quadromas: Implications for a Single-Step Purification of Bispecific Antibodies, *The Journal of Immunology*, 155:219-225 (1995).
Ling et al., Interspecies Scaling of Therapeutic Monoclonal Antibodies: Initial Look, *J. Clin. Pharmacol*, 49:1382-402 (2009).
Link et al., Production and Characterization of a Bispecific IgG Capable of Inducing T-Cell-Mediated Lysis of Malignant B Cells, *Blood*, 81(12):3343-9 (1993).
Linke et al., Catumaxomab, Clinical development and future directions, *mAbs*, 2(2):129-136 (2010).
Little et al., Letter to the Editor, "Flawed TandAb production," *Molec. Immunol.*, 44:3083 (2007).
Liu et al, Asymmetrical Fc Engineering Greatly Enhances Antibody-dependent Cellular Cytotoxicity (ADCC) Effector Function and Stability of the Modified Antibodies, *J. Biol. Chem.* 289:3571-90 (2014).
Liu et al., Crystallization of a Deglycosylated T Cell Receptor (TCR) Complexed with an Anti-TCR Fab Fragment, *J. Biol. Chem.*, 271(52):33639-46 (1996).
Liu et al., Eradication of large colon tumor xenografts by targeted delivery of maytansinoids, *Proc. Natl. Acad. Sci. USA*, 93:8618-23 (1996).
Lode et al., Targeted therapy with a novel enediyene antibiotic calicheamicins o'1 effectively suppress growth and dissemination of liver metastases in a syngeneic model of murine neuroblastoma, *Cancer Res..* 58:2928 (1998).
Loffler et al., A recombinant bispecific single-chain antibody, CD19 x CD3, induces rapid, and high lymphoma-directed cytotoxicity by unstimulated T lymphocytes, *Blood*, 95(6):2098-103 (2000).
Lu et al., A Fully Human Recombinant IgG-like Bispecific Antibody to Both the Epidermal Growth Factor Receptor and the Insulin-like Growth Factor Receptor for Enhanced Antitumor Activity, *J. Biol. Chem.*, 280(20):19665-72 (2005).
Lu et al., Di-diabody: a novel tetravalent bispecific antibody molecule by design, *J. Immunol. Meth.*, 279:219-32 (2003).
Lu et al., Fab-scFv fusion protein: an efficient approach to production of bispecific antibody fragments, *J. Immunol. Meth.*, 267:213-226 (2002).
Lu et al., The effect of variable domain orientation and arrangement on the antigen-binding activity of a recombinant human bispecific diabody, Biochemical and Biophysical Research *Communications*, 318:507-13 (2004).
Lum et al., The new face of bispecific antibodies: targeting cancer and much more, *Experimental Hematology*, 34:1-6 (2006).
Lutterbuese et al., AACR Poster, Conversion of Cetuximab, Panitumumab, Trastuzumab and Omalizumab into T Cell-engaging BiTE Antibodies Creates Novel Drug Candidates of High Potency, 2008.
Lutterbuese et al., T cell-engaging BiTE antibodies specific for EGFR potently eliminate KRAS-and BRAF-mutated colorectal cancer cells, *Proc. Natl. Acad. Sci. USA*, 107(28):12605-10 (2010).
Ma et al., Expression and Characterization of a Divalent Chimeric Anti-Human CD3 Single Chain Antibody, *Scand. J. Immunol.*, 43:134-9 (1996).
Mabry et al., A dual-targeting PDGFRVVEGF-A molecule assembled from stable antibody fragments demonstrates anti-angiogenic activity in vitro and in vivo, *mAbs*, 2(1):20-34 (2010).
Mabry et al.,Engineering of stable bispecific antibodies targeting IL-17A and 1L-23, *Protein Engineering, Design & Selection*, 23(3):115-27 (2009).
Mack et al., A small bispecific antibody construct expressed as a functional single-chain molecule with high tumor cell cytotoxicity, *Proc. Natl. Acad. Sci. USA*, 92:7021-5 (1995).
Mack et al., Biologic Properties of a Bispecific Single-Chain Antibody Directed Against 17-1A (EpCAM) and CD3—Tumor Cell-Dependent T Cell Stimulation and Cytotoxic Activity, *J. Immunol.*, 158:3965-70 (1997).
MacroGenics Factsheet, Dual Affinity Re-Targeting ("DART") Platform, (2010).
Mandler et al., Immunoconjugates of geldanamycin and anti-HER2 Monoclonal antibodies: antiproliferative activity on human breast carcinoma cell lines, *J. Nat. Cancer Inst.*, 92(19):1573-1581 (2000).
Mandler et al., Modifications in synthesis strategy improve the yield and efficacy of geldanamycin-herceptin immunoconjugates, *Bioconjugate Chem.*, 13:786-91 (2002).
Mandler et al., Synthesis and evaluation of antiproliferative activity of a geldanaymcin-herceptinTM immunoconjugates, *Bioorganic & Med. Chem. Letters*, 10:1025-8 (2000).
Mandy et al., Effect of Reduction of Several Disulfide Bonds on the Properties and Recombination of Univalent Fragments of Rabbit Antibody, *J. Biol. Chem.*, 238(1):206-13 (1963).
Mandy et al., Recombination of Univalent Subunits Derived from Rabbit Antibody, *The Journal of Biological Chemistry*, 236(12): 3221-26 (1961).
Marks et al., By-passing immunization: building high affinity human antibodies by chain shuffling, *Biotechnology*, 10:779-83 (1992).
Martin et al., Generation of the Germline Peripheral B Cell Repertoire: VH81X-A B Cells Are Unable to Complete All Developmental Programs, *J. Immunol.*, 160:3748-58 (1998).
Martinez, et al., Characterization of a novel modification on IgG2 light chain: Evidence for the presence of 0-linked mannosylation, *J. Chromatogr. A*, 1156:183-7 (2007).
Marvin et al., Recombinant approaches to IgG-like bispecific antibodies, *Acta. Pharmacologica Sinica*, 26(6):649-65 (2005).

(56) References Cited

OTHER PUBLICATIONS

Marvin, Bispecific antibodies for dual-modality cancer therapy: killing two signaling cascades with one stone, *Curr. Opin. Drug. Discov. Devel.*, 9(2):184-93 (2006).
Mateo et al, Humanization of a mouse nonoclonal antibody that blocks the epidermal growth factor receptor: recovery of antagonistic activity, *Immunotechnology*, 3(1):71-81 (1997).
McPhee, Engineering human immunodeficiency virus 1 protease heterodimers as macromolecular inhibitors of viral maturation, *Proc. Natl. Acad. Sci. USA*, 93:11477-81 (1996).
Meijer et al., Isolation of Human Antibody Repertoires with Preservation of the Natural Heavy and Light Chain Pairing, *J. Mol. Biol.*, 358:764-72 (2006).
Merchant et al., An efficient route to human bispecific IgG, *Nature Biotechnology*, 16:677-81 (1998).
Mertens et al., Tribodies: Fab-scFv fusion proteins as a platform to create multi-functional pharmaceuticals, SpringerLink, 135-149 (2011).
Metz et al., Bispecific antibody derivatives with restricted binding functionalities that are activated by proteolytic processing, *Protein Engineering, Design & Selection*, 25(10):571-80 (2012).
Metz et al., Bispecific digoxigenin-binding antibodies for targeted payload delivery, *Proc. Natl. Acad. Sci. USA*, 108(20):8194-9 (2011).
Michaelson et al., Anti-tumor activity of stability-engineered IgG-like bispecific antibodies targeting TRAIL-R2 and LTBR, *mAbs*, 1(4):128-41 (2009).
Michalk et al., Characterization of a novel single-chain bispecific antibody for retargeting of T cells to tumor cells via the TCR co-receptor CD8., *PLoS One*, 9(4):e95517 (2014).
Miller et al., Stability engineering of scFvs for the development of bispecific and multivalent antibodies, *PEDS*, 23(7):549-57 (2010).
Miller, biogen idec Stability Engineering and Production of IgG-like Bispecifc Antibodies, AAPS National Biotechnology Conference, Jun. 24 to Jun. 27, 2007.
Milutinovic, et al., "Development of a novel dual agonist SurrobodyTM that simultaneously activates both death receptors DR4 and DR5 and induces cancer cell death with high potency" Sanford Burnham Medical Research Institute / AACR Poster, #4318.
Mimoto et al., Engineered antibody Fc variant with selectively enhanced FcγRIIb binding over both FcγRIIa(R131) and FcγRIIa(H131)., *Protein Eng. Des. Sel.*, 26(10):589-98 (2013).
Mimoto et al., Novel asymmetrically engineered antibody Fc variant with superior FcγR binding affinity and specificity compared with afucosylated Fc variant, *mAbs*, 5(2):229-23 (2013).
Modjtahedi et al, Phase I trial and tumour localization of the anti-EGFR monoclonal antibody ICR62 in head and neck or lung cancer, *Br. J. Cancer*, 73(2):228-35 (1996).
Modjtahedi et al, Targeting of cells expressing wild-type EGFR and type-III mutant EGFR (EGFRVIII) by anti-EGFR MaB ICR62: a two-pronged attack for tumor therapy, *Int. J. Cancer*, 105(2):273-80 (2003).
Modjtahedi et al., Antitumor activity of combinations of antibodies directed against different epitopes on the extracellular domain of the human EGF receptor, *J. Cell Biophys.*, 22(1-3):129-46 (1993).
Modjtahedi et al., The human EGF receptor as a target for cancer therapy: six new rat mAbs against the receptor on the breast carcinoma MDA-MB 468, 1993, *Br. J. Cancer*, 67(2):247-53 (1993).
Molhoj et la., CD19-/CD3-bispecific antibody of the BiTE class is far superior to tandem diabody with respect to redirected tumor cell lysis, *Molec. Immunol.*, 44:1935-43 (2007).
Moore et al., A novel bispecific antibody format enables simultaneous bivalent and monovalent co-engagement of distinct target antigens., MAbs. Nov.-Dec. 2011; 3(6): 546-557; Published online Nov. 1, 2011. doi: 10.4161/mabs.3.6.18123.
Moore et al., Tuning T Cell Affinity Improves Efficacy and Safety of Anti-CD38 x Anti-CD3 Bispecific Antibodies in Monkeys—a Potential Therapy for Multiple Myeloma., 57th ASH Annual Meeting and Exposition (Dec. 5-8, 2015), American Society of Hematology, Orlando, Florida.
Moore, et al. Application of dual affinity retargeting molecules to achieve optimal redirected T-cell killing of B-cell lymphoma, *Blood*, 117(17):4542-51 (2011).
Moretti et al., BEAT® the bispecific challenge: a novel and efficient platform for the expression of bispecific IgGs. BMC Proceedings 7(Suppl 6):09 (2013).
Morrison et al., News and Views: Two heads are better than one, *Nature Biotechnol.*, 25(11):1233-4 (2007).
Mosmann, Rapid colorimetric assay for cellular growth and survival: application to proliferation and cytotoxicity assays, *J. Immunol. Methods*, 65:55-63 (1983).
Muda et al., Therapeutic assessment of SEED: a new engineered antibody platform designed to generate mono and bispecific antibodies, *Protein Engineering. Design & Selection*, 24(5):44754 (2011).
Murthy et al., Binding of an antagonistic monoclonal antibody to an intact and fragmented EGF-receptor polypeptide, *Arch. Biochem. Biophys.*, 252(2):549-60 (1987).
Nagorsen et al., Blinatumomab: A historical perspective, *Pharmacology & Therapeutics*, 136:334-42 (2012).
Nelson et al., Point of View: Antibody fragments—Hope and hype, mAbs, 2(1):77-83 (2010).
Neville et al., Enhancement of immunotoxin efficacy by acid-cleavable cross-ling agents utilizing diphtheria toxin and toxin mutants, *Biol. Chem.*, 264:14653-61 (1989).
Nielsen et al., Human T cells resistant to complement lysis by bivalent antibody can be efficiently lysed by dimers of monovalent antibody, *Blood*, 1001(12):4067-73 (2002).
Nisonoff et al., Letters to the Editors: Recombination of a Mixture of Univalent Antibody Fragments of Different Specificity, *Arch. Biochem. Biophys.*, 460-2 (1961).
Nisonoff et al., Quantitative Estimation of the Hybridization of Rabbit Antibodies, *Nature*, 194(4826):355-9 (1962).
North et al., A New Clustering of Antibody CDR Loop Conformations, *J. Mol. Biol.*, 406:228-56 (2011).
O'Connor et al., Humanization of an antibody against human protein C and calcium-dependence involving framework residues, *Protein Eng*, 11:321-8 (1998).
Olafsen et al., Covalent disulfide-linked anti-CEA diabody allows site-specific conjugation and radiolabeling for tumor targeting applications, *Protein Engineering, Design & Selection*, 17(1):21-7 (2004).
Osol (Ed)., Remington's Pharmaceutical sciences, 16th Ed. (1980). (Book Abstract).
Page et al., A new fluorometric assay for cytotoxicity measurements in-vitro, *International J. Oncol.*, 3:473-476 (1993).
Panke et al., Quantification of cell surface proteins with bispecific antibodies, *Protein Engineering, Design & Selection*, 26(10): 645-654 (2013).
Pessano et al., The T3/T cell receptor complex: antigenic distinction between the two 20-kd T3 (T3-6 and T3-E) subunits, *EMBO J.*, 4(2):337-44 (1985).
Pettit et al., Antineoplastic agents 365. Dolastatin 10 SAR probes, *Anti-Cancer Drug Design* 13:243-77 (1998).
Pettit et al., Dolastatins 24. Synthesis of (−)-dolastatin 10.1 X-ray molecular structure of N,N-dimethylvalyl-valyl-dolaisoleuine tert-butyl ester, *J. Chem. Soc. Perkin Trans.*, 1(5):859-863 (1996).
Pettit et al., Specific activities of dolastatin 10 and peptide derivatives against Cryptococcus neoformans, *Antimicrob. Agents Chemother*, 42(11):2961-5 (1998).
Pettit et al., Structure-activity studies with chiral isomers and with segments of the antimitotic marine peptide dolastation 10, *J. Am. Chem. Soc.*, 111:5463-5 (1989).
Pettit et al., The dolastatins; 18: Sterospecific synthesis of dolaproinel, *Synthesis*, 719-25 (1996).
Pichler et al., Differences of T-Cell Activation by the Anti-CD3 Antibodies Leu4 and BMA030, *Cell. Immunol.*, 108(1):175-87 (1987).
Potapov et al., Protein-Protein Recognition: Juxtaposition of Domain and Interface Cores in Immunoglobulins and Other Sandwich-like Proteins, *J. Mol. Biol.*, 342:665-79 (2004).
Presta et al., Humanization of an anti-vascular endothelial growth factor monoclonal antibody for the therapy of solid tumors and other disorders, *Cancer Res.*, 57(20):4593-9 (1997).

(56) References Cited

OTHER PUBLICATIONS

Queen et al., A humanized antibody that binds to the interleukin 2 receptor, *Proc. Natl. Acad. Sci. USA*, 86:10029-33 (1989).
Rader et al., A phage display approach for rapid antibody humanization: designed combinatorial V gene libraries, *Proc. Natl. Acad. Sci. USA*, 95:8910-5 (1998).
Raghavan et al., Fc receptors and their interactios with immunoglobulins, *Annu. Rev. Cell. Dev. Biol.*, 12:181-220 (1996).
Rattel et al., AACR Poster, Validation of Cynomolgus Monkeys as Relevant Species for Safety Assessment of a Novel Human BiTE Antibody Platform for Cancer Therapy ( 2010).
Reddy et al., Elimination of Fc receptor-dependent effector functions of a modified IgG4 monoclonal antibody to human CD4., *J Immunol.*, 164(4):1925-33 (2000).
Reiter et al., Disulfide stabilization of antibody Fv: computer predictions and experimental evaluation, *Protein Eng.*, 8(12):1323-31 (1995).
Reiter et al., Engineering interchain disulfide bonds into conserved framework regions of Fv fragments: improved biochemical characteristics of recombinant immunotoxins containing disulfide-stabilized Fv, *Protein Eng.*, 7(5):697-704 (1994).
Repp et al., Combined Fc-protein- and Fc-glyco-engineering of scFv-Fc fusion proteins synergistically enhances CD16a binding but does not further enhance NK-cell mediated ADCC, *J. Immunol. Meth.*, 373(1-2):67-78 (2011).
Ridgway et al., Knobs-into-holes' engineering of antibody CH3 domains for heavy chain heterodimerization, *Protein Engineering*, 9(7):617-21 (1996).
Riechmann et al., Reshaping human antibodies for therapy, *Nature*, 332:323-9 (1988).
Riethmuller, Symmetry breaking: bispecific antibodies, the beginnings, and 50 years on, *Cancer Immunity*, 12(12):1-7 (2012).
Rodeck et al., Interactions between growth factor receptors and corresponding monoclonal antibodies in human tumors, *J. Cell Biochem.*, 35(4):315-20 (1987).
Roguska et al., Humanization of murine monoclonal antibodies through variable domain resurfacing, *Proc. Natl. Acad. Sci. USA*, 91:969-73 (1994).
Roosnek et al., Triggering T Cells by Otherwise Inert Hybrid Anti-CD3/Antitumor Antibodies Requires Encounter with the Specific Target Cell, *J. Exp. Med.*, 170:297-302 (1989).
Roque et al., Antibodies and genetically engineered related molecules: production and purification, *Biotechnol. Prog.*, 20:639-54 (2004).
Rose et al., Mutation of Y407 in the CH3 domain dramatically alters glycosylation and structure of human IgG, *mAbs*, 5(2):219-28 (2013).
Rose et al., Quantitative Analysis of the Interaction Strength and Dynamics of Human IgG4 Half Molecules by Native Mass Spectrometry, *Structure*, 19:1274-82 (2011).
Rosok et al., A combinatorial library strategy for the rapid humanization of anticarcinoma BR 96 Fab, *J. Biol. Chem.*, 271(37):22611-8 (1996).
Rossi et al., A new class of bispecific antibodies to redirect T cells for cancer immunotherapy, *mAbs*, 6(2):381-91 (2014).
Rothlisberger et al., Domain Interactions in the Fab Fragment: A Comparative Evaluation of the Single-chain Fv and Fab Format Engineered with Variable Domains of Different Stability, *J. Mol. Biol.*, 347:773-89 (2005).
Roux et al., Structural analysis of the nurse shark (new) antigen receptor (NAR): Molecular convergence of NAR and unusual mammalian immunoglobulins, *Proc. Natl. Acad. Sci. USA*, 95:11804-9 (1998).
Rudnick et al., Affinity and Avidity in Antibody-Based Tumor Targeting, *Cancer Biotherapy and Radiopharmaceuticals*, 24(2):155-61 (2009).
Salmeron et al., A conformational epitope expressed upon association of CD3-epsilon with either CD3-delta or CD3-gamma is the main target for recognition by anti-CD3 monoclonal antibodies, Nov. 1, 1991.
Sancho et al., CD3-zeta Surface Expression Is Required for CD4-p56ick-mediated Up-regulation of T Cell Antigen Receptor-CD3 Signaling in T Cells, 267(11): 7871-9 (1992).
Schaefer et al., A Two-in-One Antibody against HER3 and EGFR Has Superior Inhibitory Activity Compared with Monospecific Antibodies, *Cancer Cell*, 20:472-86 (2011).
Schaefer, et al., Immunoglobulin domain crossover as a generic approach for the production of bispecific IgG antibodies, *PNAS*, 108(27):11187-92 (2011).
Schlapschy et al., Functional humanization of an anti-CD16 Fab fragment: obstacles of switching from murine A to human A or K light chains, *Protein Engineering, Design & Selection*, 22(3):17588 (2009).
Schlereth et al., Eradication of Tumors from a Human Colon Cancer Cell Line and from Ovarian Cancer Metastases in Immunodeficient Mice by a Single-Chain Ep-CAM-/CD3-Bispecific Antibody Construct, *Cancer Res.*, 65(7):2882-89 (2005).
Schlereth et al., T-cell activation and B-cell depletion in chimpanzees treated with a bispecific anti-CD19/anti-CD3 single-chain antibody construct, *Cancer Immunol Immunother*, 55:503-14 (2006).
Schoonjans et al., Fab Chains As an Efficient Heterodimerization Scaffold for the Production of Recombinant Bispecific and Trispecific Antibody Derivatives, *J. Immunol.*, 165:7050-57 (2000).
Schroder et al., The Peptides, 76-136, (1965).
Senter et al, Proceedings of the American Association for Cancer Research, 45:623 (2004).
Senter, Potent antibody drug conjugates for cancer therapy, *Current Opin. Chem. Biol.*, 13:235 (2009).
Shalaby et al., Development of humanized bispecific antibodies reactive with cytotoxic lymphocytes and tumor cells overexpressing the HER2 protooncogene, *J. Exp. Med.*, 175:217-25 (1992).
Shan et al., Characterization of scFv-Ig Constructs Generated from the Anti-CD20 mAb 1F5 Using Linker Peptides of Varying Lengths, *J. Immunol.*, 162:6589-95 (1999).
Shearman et al., Construction, Expression and Characterization of Humanized Antibodies Directed Against the Human a/R T Cell Receptor, *J. Immunol.*, 147(12):4366-73 (1991).
Shen et al., Catumaxomab, a rat/murine hybrid trifunctional bispecific monoclonal antibody for the treatment of cancer, *Curr. Opin. Mol. Ther.*, 10(3): 273-84 (2008).
Shen et al., Single Variable Domain-IgG Fusion: A Novel Recombinant Approach to Fc Domain-Containing Bispecific Antibodies, *J. Biol. Chemistry*, 281(16):10706-14 (2006).
Shields et al., Lack of fucose on human IgG1 N-linked oligosaccharide improves binding to human FcyRIII and antibody-dependent cellular toxicity, *J. Biol. Chem.*, 277:26733-40 (2002).
Shier et al., Identification of functional and structural amino-acid residues by parsimonious mutagenesis, *Gene*, 169:147-55 (1995).
Shinkawa et al., The absence of fucose but not the presence of galactose or bisecting N-acetylglucosamine of human IgG1 complex-type oligosaccharides shows the critical role of enhancing antibody-dependent cellular cytotoxicity, *J. Biol. Chem.*, 278:3466-73 (2003).
Skehan et al., Identification of functional and structural amino-acid residues by parsimonious mutagenesis, *J. Natl. Cancer Inst.*, 82(13):1107-12 (1990).
Soumyarani et al., Oxidatively modified high density lipoprotein promotes inflammatory response in human monocytes-macrophages by enhanced production of ROS, TNF-a, MMP-9, and MMP-2., *Mol. Cell. Biochem.*, 366(1-2):277-85 (2012).
Spiess et al., Alternative molecular formats and therapeutic applications for bispecific antibodies., *Mol. Immunol.*, 67(2 Pt A):95-106 (2015).
Spiess et al., Bispecific antibodies with natural architecture produced by co-culture of bacteria expressing two distinct half-antibodies, *Nature Biotechnology*, 2013.
Stamova et al., Unexpected recombinations in single chain bispecific anti-CD3- anti-CD33 antibodies can be avoided by a novel linker module, 49(3):474-82 (2011).
Stanfield et al., Maturation of Shark Single-domain (IgNAR) Antibodies: Evidence for Induced-fit Binding, *J. Mol. Biol.*, 367:358-72 (2007).

(56) References Cited

OTHER PUBLICATIONS

Stewart et al., Recombinant CD36 inhibits oxLDL-induced ICAM-1-dependent monocyte adhesion., *Mol. Immunol.*, 43(3):255-67 (2006).
Strop et al., Generating Bispecific Human IgG1 and IgG2 Antibodies from Any Antibody Pair, *J. Mol. Biol.*, 420(3):204-19 (2012).
Szymkowski et al., Creating the next generation of protein therapeutics through rational drug design, Current opinion in drug discovery & development, 590 (2005).
Tan et al., "Superhumanized" antibodies: reduction of immunogenic potential by complementarity-determining region grafting with human germline sequences: application to an anti-CD28, *J. Immunol.*, 169:1119-25 (2002).
Tan, Bi-specific ADAPTIR Molecule Targeting CD86 and Delivering Monomeric IL10 to Inhibit Antigen Presenting Cells, Presentation at PepTalk, Jan. 25, 2013.
Tang et al., Selection of linkers for a catalytic single-chain antibody using phage display technology, *J. Biological Chemistry*, 271(26):15682-9285 (1996).
Tarcsa et al, Chapter 10 Dual-Variable Domain Immunoglobulin (DVD-IgTM) Technology: A Versatile, Novel Format for the Next Generation of Dual-Targeting Biologics, *Bispecific Antibodies*, 171-185 (2011).
Teachey et al., Cytokine release syndrome after blinatumomab treatment related to abnormal macrophage activation and ameliorated with cytokine-directed therapy, *Blood*, 121(26):5154-7 (2013).
Tedgui, et al., Cytokines in atherosclerosis: pathogenic and regulatory pathways., *Physiol Rev.*, 86(2):515-81 (2006).
Thompson et al., An Anti-CD3 Single-chain Immunotoxin with a Truncated Diphtheria Toxin Avoids Inhibition by Pre-existing Antibodies in Human Blood, *J. Biol. Chem.*, 270(47): 28037-41 (1995).
Thompson et al., Improved binding of a bivalent single-chain immunotoxin results in increased efficacy for in vivo T-cell depletion, *Protein Engineering*, 14(12):1035-41 (2001).
Thorne et al., CD36 is a receptor for oxidized high density lipoprotein: implications for the development of atherosclerosis., *FEBS Lett.*, 20:581(6):1227-32 (2007).
Thorpe et al., New coupling agents for the synthesis of immunotoxins containing a hindered disulfide bond with improved stability in Vivo, *Cancer Res.* 47:5924-31 (1987).
Thotakur et al., Enzymatic deglycosylating of glycoproteins, *Meth. Enzymol.* 138:350 (1987).
Thurman et al., Detection of complement activation using monoclonal antibodies against C3d., *J. Clin. Invest.*, 123(5):2218-30 (2013).
Tomlinson et. al., Methods for generating multivalent and bispecific antibody fragments, *Methods Enzymol.*, 326:461-79 (2000).
Topp et al., Targeted Therapy With the T-Cell-Engaging Antibody Blinatumomab of Chemotherapy-Refractory Minimal Residual Disease in B-Lineage Acute Lymphoblastic Leukemia Patients Results in High Response Rate and Prolonged Leukemia-Free Survival, *J. Clin. Oncol.*, 29(18):2493-98 (2011).
Traunecker, et al., Bispecific single chain molecules (Janusins) target cytotoxic lymphocytes on HIV infected cells, *The EMBO J.*, 1(12):3655-9 (1991).
Tsurushita et al., Humanization of monoclonal antibodies, *Molecular Biology of B Cells*, 533-545 (2004).
Umana et al., Engineered glycoforms of an antineuro-blastoma IgG1 with optimized antibody-dependent cellular cytotoxic activity, *Nat. Biotechnol.*, 17:176-80 (1999).
Unknown Author, "A method for making multispecific antibodies having heteromultimeric and common components", Expert Opinion on Therapeutic Patents, Genentech, Inc. 9(6): 785-790 (1999).
Valliere-Douglass et al., O-Fucosylation of an antibody light chain: Characterization of a modification occurring on an IgG1 molecule, *Glycobiology*, 19(2):144-52 (2009).
Van Boxel, et al., Some lessons from the systematic production and structural analysis of soluble a8 T-cell receptors, *Journal of Immunological Methods*, 350:14-21 (2009).

Van Wauwe, et al., OKT3: A Monoclonal Anti-Human T Lymphoctye Antibody with Potent Mitogenic Properties, *J. Immunol.*, 124(6):2708-13 (1980).
Verdier et al., Determination of lymphocyte subsets and cytokine levels in Cynomolgus monkeys, *Toxicology*, 105:81-90 (1995).
Verhoeyen et al., Reshaping human antibodies: grafting an antilysozyme activity, *Science*, 239:1534-6 (1988).
Veri et al., Therapeutic Control of B Cell Activation via Recruitment of Fcγ Receptor IIb (CD32B) Inhibitory Function With a Novel Bispecific Antibody Scaffold, *Arthritis & Rheumatism*, 62(7):1933-43 (2010).
Vettermann et al., Powered by pairing: The surrogate light chain amplifies immunoglobulin heavy chain signaling and pre-selects the antibody repertoire, *Seminars in Immunology*, 44-55 (2006).
Von Kreudenstein et al., Improving biophysical properties of a bispecific antibody scaffold to aid developability: Quality by molecular design, *mAbs*, 5(5):1-9, (2013).
Wang et al., A block in both early T lymphocyte and natural killer cell development in transgenic mice with high-copy numbers of the human CD3E gene, *Proc. Natl. Acad. Sci. USA*, 91:9402-6 (1994).
Wang et al., Conserved amino acid networks involved in antibody variable domain interactions, *Proteins*, 76:99-114 (2009).
Wang et al., Expression and characterization of recombinant soluble monkey CD3 molecules: mapping the FN18 polymorphic epitope, *Molecular Immunology*, 40:1179-88 (2004).
Ward et al., Protein Engineering of Homodimeric Tyrosyl-tRNA Synthetase to Produce Active Heterodimers, *J. Biological Chemistry*, 261(21):9576-8 (1986).
Wawrzynczak et al., Methods for preparing immunotoxins: Effect of the linkage on activity and stability. In Immunoconjugates. Antibody Conjugates in Radio imaging and Therapy of Cancer. (C.-W. Vogel, editor). New York, Oxford University Press, pp. 28-55.
Weatherill et al., Towards a universal disulphide stabilised single chain Fv format: importance of interchain disulphide bond location and vL—vH orientation. Protein Engineering, Design & Selection, 25(7):321-9 (2012).
Weiner et al., The Role of T Cell Activation Bispecific Antibody Therapy in Anti-CD3 X Antitumor, *J. Immunol.*, 152:2385-92 (1994).
Wesolowski . esolowski et al., Single domain antibodies: promising experimental and therapeutic tools in infection and immunity, *Med. Microbiol. Immunol.*, 198:157-74 (2009).
Whitlow., et al., An improved linker for single-chain Fv with reduced aggregation and enhanced proteolytic stability, *Protein Engineering*, 6(8):989-95 (1993).
Wigginton et al., An immunoglobulin E-reactive chimeric human immunoglobulin G1 anti-idiotype inhibits basophil degranulation through cross-linking of FcεRI with FcγRIIb, *Clin. Exper. Allergy*, 38: 313-19 (2007).
Wong, et al., The Mechanism of Anti-CD3 Monoclonal Antibodies, *Transplantation*, 50(4):683-9 (1990).
Woods, et al., LC-MS characterization and purity assessment of a prototype bispecific antibody, *mAbs*, 5(5):711-22 (2013).
Woyke et al., In vitro activities and postantifungal effects of the potent dolastation 10 derivative auristatin PHE, *Antimicrob. Agents and Chemother.*, 45(12):3580-84 (2001).
Wu et al, Molecular construction and optimization of anti-human IL-11a/8 dual; variable domain immunoglobulin (DVD-IgTM) molecules, *Mabs*, 1(4):339-47 (2009).
Wu et al, Simultaneous targeting of multiple disease mediators by a dual-variable-domain immunoglobulin, (DVD-IgTM) molecules, 339-347 (2007).
Wu et al., Humanization of a murine monoclonal antibody by simultaneous optimization of framework and CDR residues, *J. Mol. Biol.* 294:151-62 (1999).
Wu, et al., Multimerization of a chimeric anti-CD20 single-chain Fv-Fc fusion protein is mediated through variable domain exchange, *Protein Engineering*, 14(12):1025-33 (2001).
Wucherpfennig et al., Structural Biology of the T-cell Receptor: Insights into Receptor Assembly, Ligand Recognition, and Initiation of Signaling, *Cold Spring Harb. Perspect. Biol.*, 2:a005140 (2010).

(56) References Cited

OTHER PUBLICATIONS

Xie et al., A new format of bispecific antibody: highly efficient heterodimerization, expression and tumor cell lysis, *J. Immunol. Meth.*, 296:95-101 (2005).
Xu et al., Combinatorial surrobody libraries, *PNAS*, 105(31):10756-61 (2008).
Xu et al., Rapid optimization and prototyping for therapeutic antibody-like molecules, *mAbs*, 5(2):237-54 (2013).
Xu et al., Surrobodies with Functional Tails, *J. Mol. Biol.*, 397:352-60 (2010).
Yang et al., Differential in vitro activation of CD8-CD4+ and CD4-CD8+ T lymphocytes by combinations of anti-CD2 and anti-CD3 antibodies, *J. Immunol.*, 140(7):2115-20 (1988).
Yelton et al., Affinity maturation of the BR96 anti-carcinoma antibody by codon-based mutagenesis, *J. Immunol.*, 155:1994-2004 (1995).
Yeung, et al., Engineering human IgG1 affinity to human neonatal Fc receptor: impact of affinity improvement on pharmacokinetics in primates, *J Immunol.*, 182(12):7663-71 (2009).
Yoshino et al., Upgrading of flow cytometric analysis for absolute counts, cytokines and other antigenic molecules of cynomolgus monkeys (*Macaca fascicularis*) by using anti-human cross-reactive antibodies, *Exp. Anim.*, 49(2): 97-100 (2000).
Yu et al., The biosynthetic gene cluster of the maytansinoids antitumor agent ansamitocin from actinosynnema pretiosum, *PNAS.* 99:7968-73 (2002).
Zalevsky et al., Enhanced antibody half-life improves in vivo activity, *Nature Biotechnology*, 28(2):157-9 (2010).
Zamyatnin, Amino acid, peptide, and protein volume in solution, *Annu. Rev. Biophys. Bioeng.*, 13:145-65 (1984).
Zeidler et al., The Fc-region of a new class of intact bispecific antibody mediates activation of accessory cells and NK cells and induces direct phagocytosis of tumour cells, *Br. J. Cancer.*, 83(2):261-66 (2000).
Zhu et al., Identification of Heavy Chain Residues in a Humanized Anti-CD3 Antibody Important for Efficient Antigen Binding and T Cell Activation, *J. Immunol.*, 155:1903-10 (1995).
Zhu et al., Remodeling domain interfaces to enhance heterodimer formation, *Protein Science*, 6:781-8 (1997).
Ziebig et al., Effect of the oxLDL Binding Protein Fc-CD68 on Plaque Extension and Vulnerability in Atherosclerosis, *Circ. Res.*, 108: 695-703 (2011).
Zuo et al., An efficient route to the production of an IgG-like bispecific antibody, *Protein Engineering*, 13(5):361-367 (2000).
Chu et al., Immunotherapy with Long-Lived Anti-CD38 x Anti-CD3-Bispecific Antibodies Stimulates Potent T Cell-Mediated Killing of Human Myeloma Cell Lines and CD38+ Cells in Monkeys: A Potential Therapy for Multiple Myeloma, *Blood*, 124(21):4727 (2014).
J. Deckert et al., "A Novel Humanized CD38-Targeting Antibody, Demonstrates Potent Antitumor Activity in Models of Multiple Myeloma and Other CD38+ Hematologic Malignancies", Clinical Cancer Research, vol. 20, No. 17, pp. 4574-4583 (Sep. 2014).
M. De Weers et al., "Daratumumab, a Novel Therapeutic Human CD38 Monoclonal Antibody, Induces Killing of Multiple Myeloma and Other Hematological Tumors", The Journal of Immunology, vol. 186, No. 3, pp. 1840-1848 (Dec. 2010).
U.S. Appl. No. 12/875,015, 2011-0054151, U.S. Pat. No. 9,493,578, filed Sep. 2, 2010, Mar. 3, 2011, Nov. 15, 2016.
U.S. Appl. No. 15/279,266, 2017-0058053, filed Sep. 28, 2016, Mar. 2, 2017.
U.S. Appl. No. 13/648,951, 2013-0171095, filed Oct. 10, 2012, Jul. 4, 2013.
U.S. Appl. No. 13/194,904, 2012-0028304, U.S. Pat. No. 8,637,641, filed Jul. 29, 2011, Feb. 2, 2012, Jan. 28, 2014.
U.S. Appl. No. 14/165,487, 2014-0249297, U.S. Pat. No. 9,605,061, filed Jan. 27, 2014, Sep. 4, 2014, Mar. 28, 2017.
U.S. Appl. No. 15/444,087, 2017-0174757, filed Feb. 27, 2017, Jun. 22, 2017.
U.S. Appl. No. 13/568,028, filed Aug. 6, 2012.
U.S. Appl. No. 14/853,622, 2016-0068588, filed Sep. 14, 2015, Mar. 10, 2016.
U.S. Appl. No. 13/887,234, filed May 3, 2013.
U.S. Appl. No. 14/156,431, 2014-0212435, filed Jan. 15, 2014, Jul. 31, 2014.
U.S. Appl. No. 14/156,432, 2014-0212436, filed Jan. 15, 2014, Jul. 31, 2014.
U.S. Appl. No. 14/808,826, 2016-0060360, U.S. Pat. No. 9,738,722, filed Jul. 24, 2015, Mar. 3, 2016, Aug. 22, 2017.
U.S. Appl. No. 15/682,380, filed Aug. 21, 2017.
U.S. Appl. No. 14/155,248, 2014-0322217, filed Jan. 14, 2014, Oct. 30, 2014.
U.S. Appl. No. 14/155,334, 2014-0370013, filed Jan. 14, 2014, Dec. 18, 2014.
U.S. Appl. No. 14/155,344, 2014-0294833, U.S. Pat. No. 9,701,759, filed Jan. 14, 2014, Oct. 2, 2014, Jul. 11, 2017.
U.S. Appl. No. 14/205,227, 2014-0294835, filed Mar. 11, 2014, Oct. 2, 2014.
U.S. Appl. No. 14/205,248, 2014-0288275, U.S. Pat. No. 9,650,446, filed Mar. 11, 2014, Sep. 25, 2014, May 16, 2017.
U.S. Appl. No. 15/589,908, filed May 8, 2017.
U.S. Appl. No. 14/214,418, 2014-0356381, filed Mar. 14, 2014, Dec. 4, 2014.
U.S. Appl. No. 14/214,475, 2014-0294836, filed Mar. 14, 2014, Oct. 2, 2014.
U.S. Appl. No. 14/217,166, 2014-0294759, filed Mar. 17, 2014, Oct. 2, 2014.
U.S. Appl. No. 14/200,652, 2014-0302064, filed Mar. 7, 2014, Oct. 9, 2014.
U.S. Appl. No. 14/207,489, 2014-0377270, filed Mar. 12, 2014, Dec. 25, 2014.
U.S. Appl. No. 14/200,821, 2014-0294823, U.S. Pat. No. 9,605,084, filed Mar. 7, 2014, Oct. 2, 2014, Mar. 28, 2017.
U.S. Appl. No. 14/216,705, 2014-0363426, filed Mar. 17, 2014, Dec. 11, 2014.
U.S. Appl. No. 15/444,026, filed Feb. 27, 2017.
U.S. Appl. No. 14/673,695, 2015-0307629, U.S. Pat. No. 9,822,186, filed Mar. 30, 2015, Oct. 29, 2015, Nov. 21, 2018.
U.S. Appl. No. 15/786,252, filed Oct. 17, 2017.
U.S. Appl. No. 14/952,705, 2016-0176969, filed Nov. 25, 2015, Jun. 23, 2016.
U.S. Appl. No. 14/952,714, 2016-0229924, filed Nov. 25, 2015, Aug. 11, 2016.
U.S. Appl. No. 15/141,350, 2016-0355608, filed Apr. 28, 2016, Dec. 8, 2016.
U.S. Appl. No. 14/952,786, 2016-0215063, filed Nov. 25, 2015, Jul. 28, 2016.
U.S. Appl. No. 14/757,809, 2016-0355600, filed Dec. 22, 2015, Dec. 8, 2016.
U.S. Appl. No. 15/063,441, 2017-0037131, filed Mar, 7, 2016, Feb. 9, 2017.
U.S. Appl. No. 15/372,360, 2017-0320947, filed Dec. 7, 2016, Nov. 9, 2017.
U.S. Appl. No. 15/611,361, filed Jun. 1, 2017.
U.S. Appl. No. 15/611,683, filed Jun. 1, 2017.
U.S. Appl. No. 15/636,590, filed Jun. 28, 2017.
U.S. Appl. No. 15/185,958, 2017-0081420, U.S. Pat. No. 9,850,320, filed Jun. 17, 2016, Mar. 23, 2017, Dec. 26, 2017.
U.S. Appl. No. 15/186,167, 2017-0081424, U.S. Pat. No. 9,856,327, filed Jun. 17, 2016, Mar. 23, 2017, Jan. 2, 2018.
U.S. Appl. No. 15/691,665, filed Aug. 30, 2017.
U.S. Appl. No. 15/785,401, filed Oct. 16, 2017.
U.S. Appl. No. 15/785,393, filed Oct. 16, 2017.
Wang Dong et al., Comparison of Biologic Activity of Two Anti-PSA/Anti-CD3 Bispecific Single-chain Antibodies, National Journal of Andrology, vol. 13(1), pp. 8-12 (2007).

* cited by examiner

Figure 1A

CD38 (Full Sequence)    (SEQ ID NO:460)

MANCEFSPVSGDKPCCRLSRRAQLCLGVSILVLILVVVLAVVVPRWRQQWSGPGTTKRFPETVLARCVKYTEIHPEMRH
VDCQSVWDAFKGAFISKHPCNITEEDYQPLMKLGTQTVPCNKILLWSRIKDLAHQFTQVQRDMFTLEDTLLGYLADDL
TWCGEFNTSKINYQSCPDWRKDCSNNPVSVFWKTVSRRFAEAACDVVHVMLNGSRSKIFDKNSTFGSVEVHNLQPEK
VQTLEAWVIHGGREDSRDLCQDPTIKELESIISKRNIQFSCKNIYRPDKFLQCVKNPEDSSCTSEI

Figure 1B

CD38 (Extracellular domain only)    (SEQ ID NO:461)

VPRWRQQWSGPGTTKRFPETVLARCVKYTEIHPEMRHVDCQSVWDAFKGAFISKHPCNITEEDYQPLMKLGTQTVPC
NKILLWSRIKDLAHQFTQVQRDMFTLEDTLLGYLADDLTWCGEFNTSKINYQSCPDWRKDCSNNPVSVFWKTVSRRFA
EAACDVVHVMLNGSRSKIFDKNSTFGSVEVHNLQPEKVQTLEAWVIHGGREDSRDLCQDPTIKELESIISKRNIQFSCKN
IYRPDKFLQCVKNPEDSSCTSEI

Figure 2

HUMAN T-cell surface glycoprotein CD3 epsilon chain (SEQ ID NO:462)

MQSGTHWRVLGLCLLSVGVWGQDGNEEMGGITQTPYKVSISGTTVILTCPQYPG
SEILWQHNDKNIGGDEDDKNIGSDEDHLSLKEFSELEQSGYYVCYPRGSK
PEDANFYLYLRARVCENCMEMDVMSVATIVIVDICITGGLLLLVYYWSK
NRKAKAKPVTRGAGAGGRQRGQNKERPPPVPNPDYEPIRKGQRDLYSGL
NQRRI

Figure 3A

Humanized anti-CD3 heavy chain variable region
SEQ ID NO. 1.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS Humanized anti-CD3 light chain variable region
SEQ ID NO. 2.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11502 H1_L1.4

SEQ ID NO. 3.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 4.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 5.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 6.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11794 H1.3_L1.4

SEQ ID NO. 7.
EVQLVESGGGDVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 8.
EVQLVESGGGDVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 3B

SEQ ID NO. 9.
EVQLVESGGGDVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 10.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11795 H1.4_L1.4

SEQ ID NO. 11.
EVQLVESGGGKVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 12.
EVQLVESGGGKVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 13.
EVQLVESGGGKVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 14.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11796 H1.5_L1.4
SEQ ID NO. 15.
EVQLVESGGGNVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

XENP11796 H1.5_L1.4, cont.
SEQ ID NO. 16.
EVQLVESGGGNVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 17.
EVQLVESGGGNVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

Figure 3C

SEQ ID NO. 18.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11801 H1.6_L1.4
SEQ ID NO. 19.
EVQLVESGGGSVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 20.
EVQLVESGGGSVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 21.
EVQLVESGGGSVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 22.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11802 H1.7_L1.4

SEQ ID NO. 23.
EVQLVESGGGLVQPGGSLKLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 24.
EVQLVESGGGLVQPGGSLKLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 25.
EVQLVESGGGLVQPGGSLKLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 26.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 3D

XENP11803 H1.8_L1.4

SEQ ID NO. 27.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 28.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 29.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 30.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11804 H1.9_L1.4

SEQ ID NO. 31.
EVQLVESGGGLVQPGGSLRLSCAASGFTFNTYAMHWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 32.
EVQLVESGGGLVQPGGSLRLSCAASGFTFNTYAMHWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 33.
EVQLVESGGGLVQPGGSLRLSCAASGFTFNTYAMHWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 34.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 3E

XENP11805 H1.10_L1.4

SEQ ID NO. 35.
EVQLVESGGGLVQPGGSLRLSCAASGFTFNTYAMSWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 36.
EVQLVESGGGLVQPGGSLRLSCAASGFTFNTYAMSWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 37.
EVQLVESGGGLVQPGGSLRLSCAASGFTFNTYAMSWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 38.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11806 H1.11_L1.4

SEQ ID NO. 39.
EVQLVESGGGLVQPGGSLRLSCAASGFTFNTYAMNWVRQASGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 40.
EVQLVESGGGLVQPGGSLRLSCAASGFTFNTYAMNWVRQASGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 41.
EVQLVESGGGLVQPGGSLRLSCAASGFTFNTYAMNWVRQASGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 42.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 3F

XENP11807 H1.12_L1.4

SEQ ID NO. 43.
EVQLVESGGGLVQPGGSLRLSCAASGFTFNTYAMNWVRQAPGKGLEWVGRIRSKANNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 44.
EVQLVESGGGLVQPGGSLRLSCAASGFTFNTYAMNWVRQAPGKGLEWVGRIRSKANNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 45.
EVQLVESGGGLVQPGGSLRLSCAASGFTFNTYAMNWVRQAPGKGLEWVGRIRSKANNYATYYADSVKGRF
TISRDDSKNTLYLQMNSLRAEDTAVYYCVRHGNFGNSYVSWFAYWGQGTLVTVSS

SEQ ID NO. 46.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11808 H1.13_L1.4

SEQ ID NO. 47.
EVQLVESGGGLVQPGGSLRLSCAASGFTFNTYAMNWVRQAPGKGLEWVGRIRSKANSYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 48.
EVQLVESGGGLVQPGGSLRLSCAASGFTFNTYAMNWVRQAPGKGLEWVGRIRSKANSYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 49.
EVQLVESGGGLVQPGGSLRLSCAASGFTFNTYAMNWVRQAPGKGLEWVGRIRSKANSYATYYADSVKGRF
TISRDDSKNTLYLQMNSLRAEDTAVYYCVRHGNFGNSYVSWFAYWGQGTLVTVSS

SEQ ID NO. 50.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 3G

XENP11809 H1.14_L1.4

SEQ ID NO. 51.
EVQLVESGGGLVQPGGSLRLSCAASGFTFNTYAMNWVRQAPGKGLEWVGRIRSKYNNYATAYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 52.
EVQLVESGGGLVQPGGSLRLSCAASGFTFNTYAMNWVRQAPGKGLEWVGRIRSKYNNYATAYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 53.
EVQLVESGGGLVQPGGSLRLSCAASGFTFNTYAMNWVRQAPGKGLEWVGRIRSKYNNYATAYADSVKGRF
TISRDDSKNTLYLQMNSLRAEDTAVYYCVRHGNFGNSYVSWFAYWGQGTLVTVSS

SEQ ID NO. 54.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11810 H1.15_L1.4

SEQ ID NO. 55.
EVQLVESGGGLVQPGGSLRLSCAASGFTFNTYAMNWVRQAPGKGLEWVGRIRSKYNNYATYYAASVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 56.
EVQLVESGGGLVQPGGSLRLSCAASGFTFNTYAMNWVRQAPGKGLEWVGRIRSKYNNYATYYAASVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 57.
EVQLVESGGGLVQPGGSLRLSCAASGFTFNTYAMNWVRQAPGKGLEWVGRIRSKYNNYATYYAASVKGRF
TISRDDSKNTLYLQMNSLRAEDTAVYYCVRHGNFGNSYVSWFAYWGQGTLVTVSS

SEQ ID NO. 58.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 3H

XENP11811 H1.16_L1.4

SEQ ID NO. 59.
EVQLVESGGGLVQPGGSLRLSCAASGFTFNTYAMNWVRQAPGKGLEWVGRIRSKYNNYATYYADSVKGRF
TISRDNSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 60.
EVQLVESGGGLVQPGGSLRLSCAASGFTFNTYAMNWVRQAPGKGLEWVGRIRSKYNNYATYYADSVKGRF
TISRDNSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 61.
EVQLVESGGGLVQPGGSLRLSCAASGFTFNTYAMNWVRQAPGKGLEWVGRIRSKYNNYATYYADSVKGRF
TISRDNSKNTLYLQMNSLRAEDTAVYYCVRHGNFGNSYVSWFAYWGQGTLVTVSS

SEQ ID NO. 62.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11812 H1.17_L1.4

SEQ ID NO. 63.
EVQLVESGGGLVQPGGSLRLSCAASGFTFNTYAMNWVRQAPGKGLEWVGRIRSKYNNYATYYADSVKGRF
TISRDTSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 64.
EVQLVESGGGLVQPGGSLRLSCAASGFTFNTYAMNWVRQAPGKGLEWVGRIRSKYNNYATYYADSVKGRF
TISRDTSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 65.
EVQLVESGGGLVQPGGSLRLSCAASGFTFNTYAMNWVRQAPGKGLEWVGRIRSKYNNYATYYADSVKGRF
TISRDTSKNTLYLQMNSLRAEDTAVYYCVRHGNFGNSYVSWFAYWGQGTLVTV

SEQ ID NO. 66.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 3I

XENP11813 H1.18_L1.4

SEQ ID NO. 67.
EVQLVESGGGLVQPGGSLRLSCAASGFTFNTYAMNWVRQAPGKGLEWVGRIRSKYNNYATYYADSVKGRF
TISRDDSKNTAYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 68.
EVQLVESGGGLVQPGGSLRLSCAASGFTFNTYAMNWVRQAPGKGLEWVGRIRSKYNNYATYYADSVKGRF
TISRDDSKNTAYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 69.
EVQLVESGGGLVQPGGSLRLSCAASGFTFNTYAMNWVRQAPGKGLEWVGRIRSKYNNYATYYADSVKGRF
TISRDDSKNTAYLQMNSLRAEDTAVYYCVRHGNFGNSYVSWFAYWGQGTLVTVSS

SEQ ID NO. 70.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11814 H1.19_L1.4

SEQ ID NO. 71.
EVQLVESGGGLVQPGGSLRLSCAASGFTFNTYAMNWVRQAPGKGLEWVGRIRSKYNNYATYYADSVKGRF
TISRDDSKNTLYLQMNSLRDEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 72.
EVQLVESGGGLVQPGGSLRLSCAASGFTFNTYAMNWVRQAPGKGLEWVGRIRSKYNNYATYYADSVKGRF
TISRDDSKNTLYLQMNSLRDEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 73.
EVQLVESGGGLVQPGGSLRLSCAASGFTFNTYAMNWVRQAPGKGLEWVGRIRSKYNNYATYYADSVKGRF
TISRDDSKNTLYLQMNSLRDEDTAVYYCVRHGNFGNSYVSWFAYWGQGTLVTVSS

SEQ ID NO. 74.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 3J

XENP11815 H1.20_L1.4

SEQ ID NO. 75.
EVQLVESGGGLVQPGGSLRLSCAASGFTFNTYAMNWVRQAPGKGLEWVGRIRSKYNNYATYYADSVKGRF
TISRDDSKNTLYLQMNSLRKEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 76.
EVQLVESGGGLVQPGGSLRLSCAASGFTFNTYAMNWVRQAPGKGLEWVGRIRSKYNNYATYYADSVKGRF
TISRDDSKNTLYLQMNSLRKEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 77.
EVQLVESGGGLVQPGGSLRLSCAASGFTFNTYAMNWVRQAPGKGLEWVGRIRSKYNNYATYYADSVKGRF
TISRDDSKNTLYLQMNSLRKEDTAVYYCVRHGNFGNSYVSWFAYWGQGTLVTVSS

SEQ ID NO. 78.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11816 H1.21_L1.4

SEQ ID NO. 79.
EVQLVESGGGLVQPGGSLRLSCAASGFTFNTYAMNWVRQAPGKGLEWVGRIRSKYNNYATYYADSVKGRF
TISRDDSKNTLYLQMNSLRSEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 80.
EVQLVESGGGLVQPGGSLRLSCAASGFTFNTYAMNWVRQAPGKGLEWVGRIRSKYNNYATYYADSVKGRF
TISRDDSKNTLYLQMNSLRSEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 81.
EVQLVESGGGLVQPGGSLRLSCAASGFTFNTYAMNWVRQAPGKGLEWVGRIRSKYNNYATYYADSVKGRF
TISRDDSKNTLYLQMNSLRSEDTAVYYCVRHGNFGNSYVSWFAYWGQGTLVTVSS

SEQ ID NO. 82.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 3K

XENP11817 H1.22_L1.4

SEQ ID NO. 83.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCARHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 84.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCARHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 85.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCARHGNFGNSYVSWFAYWGQGTLVTVSS

SEQ ID NO. 86.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11818 H1.23_L1.4

SEQ ID NO. 87.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCTRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 88.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCTRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 89.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCTRHGNFGNSYVSWFAYWGQGTLVTVSS

SEQ ID NO. 90.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 3L

XENP11819 H1.24_L1.4

SEQ ID NO. 91.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 92.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 93.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 94.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11820 H1.25_L1.4

SEQ ID NO. 95.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGQSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 96.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGQSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 97.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGQSYVSWFAYWGQGTLVTVSS

SEQ ID NO. 98.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 3M

XENP11821 H1.26_L1.4

SEQ ID NO. 99.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNTYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 100.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNTYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 101.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNTYVSWFAYWGQGTLVTVSS

SEQ ID NO. 102.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11822 H1.27_L1.4

SEQ ID NO. 103.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFDYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 104.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFDYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 105.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFDYWGQGTLVTVSS

SEQ ID NO. 106.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 3N

XENP11823 H1.28_L1.4

SEQ ID NO. 107.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTTVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 108.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTTVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 109.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTTVTVSS

SEQ ID NO. 110.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11824 H1.29_L1.30

SEQ ID NO. 111.
EVQLVESGGGLVQPGGSLRLSCAASGFTFNTYAMNWVRQAPGKSLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 112.
EVQLVESGGGLVQPGGSLRLSCAASGFTFNTYAMNWVRQAPGKSLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 113.
EVQLVESGGGLVQPGGSLRLSCAASGFTFNTYAMNWVRQAPGKSLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 114.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 3O

XENP11825 H1_L1.10

SEQ ID NO. 115.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQPPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 116.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQPPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 117.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 118.
QAVVTQPPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11826 H1_L1.11

SEQ ID NO. 119.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLSVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 120.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLSVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 121.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 122.
QAVVTQEPSLSVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 3P

XENP11827 H1_L1.12

SEQ ID NO. 123.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGATVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 124.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGATVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 125.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 126.
QAVVTQEPSLTVSPGATVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11828 H1_L1.13

SEQ ID NO. 127.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGQTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 128.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGQTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 129.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 130.
QAVVTQEPSLTVSPGQTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 3Q

XENP11829 H1_L1.14

SEQ ID NO. 131.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTSSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 132.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTSSNYANWVQQKPGQAPRGLIGGTNKRAPGVPARFSGSLLG
GKAALTLSGAQPEDEAEYYCALWYSNLWVFGGGTKLTVL

SEQ ID NO. 133.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 134.
QAVVTQEPSLTVSPGGTVTLTCGSSTGAVTSSNYANWVQQKPGQAPRGLIGGTNKRAPGVPARFSGSLLG
GKAALTLSGAQPEDEAEYYCALWYSNLWVFGGGTKLTVL

XENP11830 H1_L1.15

SEQ ID NO. 135.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTSGHYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 136.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTSGHYANWVQQKPGQAPRGLIGGTNKRAPGVPARFSGSLLG
GKAALTLSGAQPEDEAEYYCALWYSNLWVFGGGTKLTVL

SEQ ID NO. 137.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 138.
QAVVTQEPSLTVSPGGTVTLTCGSSTGAVTSGHYANWVQQKPGQAPRGLIGGTNKRAPGVPARFSGSLLG
GKAALTLSGAQPEDEAEYYCALWYSNLWVFGGGTKLTVL

Figure 3R

XENP11831 H1_L1.16

SEQ ID NO. 139.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIYDTNKRAPGVPARFSGSLLG
GKAALTLSGAQPEDEAEYYCALWYSNLWVFGGGTKLTVLGSHHHHHH

SEQ ID NO. 140.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIYDTNKRAPGVPARFSGSLLG
GKAALTLSGAQPEDEAEYYCALWYSNLWVFGGGTKLTVL

SEQ ID NO. 141.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 142.
QAVVTQEPSLTVSPGGTVTLTCGSSTGAVTTSNYANWVQQKPGQAPRGLIYDTNKRAPGVPARFSGSLLG
GKAALTLSGAQPEDEAEYYCALWYSNLWVFGGGTKLTVL

XENP11832 H1_L1.17

SEQ ID NO. 143.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNNRAPGVPARFSGSLLG
GKAALTLSGAQPEDEAEYYCALWYSNLWVFGGGTKLTVLGSHHHHHH

SEQ ID NO. 144.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNNRAPGVPARFSGSLLG
GKAALTLSGAQPEDEAEYYCALWYSNLWVFGGGTKLTVL

SEQ ID NO. 145.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 146.
QAVVTQEPSLTVSPGGTVTLTCGSSTGAVTTSNYANWVQQKPGQAPRGLIGGTNNRAPGVPARFSGSLLG
GKAALTLSGAQPEDEAEYYCALWYSNLWVFGGGTKLTVL

Figure 3S

XENP11833 H1_L1.18

SEQ ID NO. 147.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRASGVPARFSGSLLG
GKAALTLSGAQPEDEAEYYCALWYSNLWVFGGGTKLTVLGSHHHHHH

SEQ ID NO. 148.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRASGVPARFSGSLLG
GKAALTLSGAQPEDEAEYYCALWYSNLWVFGGGTKLTVL

SEQ ID NO. 149.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 150.
QAVVTQEPSLTVSPGGTVTLTCGSSTGAVTTSNYANWVQQKPGQAPRGLIGGTNKRASGVPARFSGSLLG
GKAALTLSGAQPEDEAEYYCALWYSNLWVFGGGTKLTVL

XENP11834 H1_L1.19

SEQ ID NO. 151.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTSNKHSWTPARFSGSLLG
GKAALTLSGAQPEDEAEYYCALWYSNLWVFGGGTKLTVLGSHHHHHH

SEQ ID NO. 152.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTSNKHSWTPARFSGSLLG
GKAALTLSGAQPEDEAEYYCALWYSNLWVFGGGTKLTVL

SEQ ID NO. 153.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 154.
QAVVTQEPSLTVSPGGTVTLTCGSSTGAVTTSNYANWVQQKPGQAPRGLIGGTSNKHSWTPARFSGSLLG
GKAALTLSGAQPEDEAEYYCALWYSNLWVFGGGTKLTVL

Figure 3T

XENP11835 H1_L1.20

SEQ ID NO. 155.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPDRFSGSLLG
GKAALTLSGAQPEDEAEYYCALWYSNLWVFGGGTKLTVLGSHHHHHH

SEQ ID NO. 156.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPDRFSGSLLG
GKAALTLSGAQPEDEAEYYCALWYSNLWVFGGGTKLTVL

SEQ ID NO. 157.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 158.
QAVVTQEPSLTVSPGGTVTLTCGSSTGAVTTSNYANWVQQKPGQAPRGLIGGTNKRAPGVPDRFSGSLLG
GKAALTLSGAQPEDEAEYYCALWYSNLWVFGGGTKLTVL

XENP11836 H1_L1.21

SEQ ID NO. 159.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSKSG
GKAALTLSGAQPEDEAEYYCALWYSNLWVFGGGTKLTVLGSHHHHHH

SEQ ID NO. 160.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSKSG
GKAALTLSGAQPEDEAEYYCALWYSNLWVFGGGTKLTVL

SEQ ID NO. 161.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 162.
QAVVTQEPSLTVSPGGTVTLTCGSSTGAVTTSNYANWVQQKPGQAPRGLIGGTNKRAPGVPARFSGSKSG
GKAALTLSGAQPEDEAEYYCALWYSNLWVFGGGTKLTVL

Figure 3U

XENP11837 H1_L1.22

SEQ ID NO. 163.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSSSG
GKAALTLSGAQPEDEAEYYCALWYSNLWVFGGGTKLTVLGSHHHHHH

SEQ ID NO. 164.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSSSG
GKAALTLSGAQPEDEAEYYCALWYSNLWVFGGGTKLTVL

SEQ ID NO. 165.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 166.
QAVVTQEPSLTVSPGGTVTLTCGSSTGAVTTSNYANWVQQKPGQAPRGLIGGTNKRAPGVPARFSGSSSG
GKAALTLSGAQPEDEAEYYCALWYSNLWVFGGGTKLTVL

XENP11838 H1_L1.23

SEQ ID NO. 167.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNLWVFGGGTKLTVLGSHHHHHH

SEQ ID NO. 168.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNLWVFGGGTKLTVL

SEQ ID NO. 169.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 170.
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNLWVFGGGTKLTVL

Figure 3V

XENP11839 H1_L1.24

SEQ ID NO. 171.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQAEDEAEYYCALWYSNLWVFGGGTKLTVLGSHHHHHH

SEQ ID NO. 172.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQAEDEAEYYCALWYSNLWVFGGGTKLTVL

SEQ ID NO. 173.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 174.
QAVVTQEPSLTVSPGGTVTLTCGSSTGAVTTSNYANWVQQKPGQAPRGLIGGTNKRAPGVPARFSGSLLG
GKAALTLSGAQAEDEAEYYCALWYSNLWVFGGGTKLTVL

XENP11840 H1_L1.25

SEQ ID NO. 175.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQSEDEAEYYCALWYSNLWVFGGGTKLTVLGSHHHHHH

SEQ ID NO. 176.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQSEDEAEYYCALWYSNLWVFGGGTKLTVL

SEQ ID NO. 177.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 178.
QAVVTQEPSLTVSPGGTVTLTCGSSTGAVTTSNYANWVQQKPGQAPRGLIGGTNKRAPGVPARFSGSLLG
GKAALTLSGAQSEDEAEYYCALWYSNLWVFGGGTKLTVL

Figure 3W

XENP11841 H1_L1.26

SEQ ID NO. 179.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEADYYCALWYSNLWVFGGGTKLTVLGSHHHHHH

SEQ ID NO. 180.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEADYYCALWYSNLWVFGGGTKLTVL

SEQ ID NO. 181.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 182.
QAVVTQEPSLTVSPGGTVTLTCGSSTGAVTTSNYANWVQQKPGQAPRGLIGGTNKRAPGVPARFSGSLLG
GKAALTLSGAQPEDEADYYCALWYSNLWVFGGGTKLTVL

XENP11842 H1_L1.27

SEQ ID NO. 183.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCLLWYSNLWVFGGGTKLTVLGSHHHHHH

SEQ ID NO. 184.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCLLWYSNLWVFGGGTKLTVL

SEQ ID NO. 185.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 186.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCLLWYSNLWVFGGGTKLTVL

Figure 3X

XENP11843 H1_L1.28

SEQ ID NO. 187.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNHWVFGGGTKLTVLGSHHHHHH

SEQ ID NO. 188.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNHWVFGGGTKLTVL

SEQ ID NO. 189.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 190.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNHWVFGGGTKLTVL

XENP11844 H1_L1.29

SEQ ID NO. 191.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLEIKGSHHHHHH

SEQ ID NO. 192.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLEIKGS

SEQ ID NO. 193.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 194.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLEIKGS

Figure 3Y

XENP11920 H1_L3.1

SEQ ID NO. 195.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
EIVMTQSPATLSLSPGERATLSCRSSTGAVTTSNYANWVQQKPGQAPRGLIGGTNKRAPGVPARFSGSGS
GTDFTLTISSLQPEDFAVYYCALWYSNLWVFGGGTKVEIKGSHHHHHH

SEQ ID NO. 196.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
EIVMTQSPATLSLSPGERATLSCRSSTGAVTTSNYANWVQQKPGQAPRGLIGGTNKRAPGVPARFSGSGS
GTDFTLTISSLQPEDFAVYYCALWYSNLWVFGGGTKVEIKGS

SEQ ID NO. 197.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 198.
EIVMTQSPATLSLSPGERATLSCRSSTGAVTTSNYANWVQQKPGQAPRGLIGGTNKRAPGVPARFSGSGS
GTDFTLTISSLQPEDFAVYYCALWYSNLWVFGGGTKVEIKGS

XENP11921 H1_L5.1

SEQ ID NO. 199.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
DIVMTQSPDSLAVSLGERATINCKSSTGAVTTSNYANWVQQKPGQPPKGLIGGTNKRAPGVPDRFSGSGS
GTDFTLTISSLQAEDVAVYYCALWYSNLWVFGGGTKVEIKGSHHHHHH

SEQ ID NO. 200.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
DIVMTQSPDSLAVSLGERATINCKSSTGAVTTSNYANWVQQKPGQPPKGLIGGTNKRAPGVPDRFSGSGS
GTDFTLTISSLQAEDVAVYYCALWYSNLWVFGGGTKVEIKGS

SEQ ID NO. 201.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 202.
DIVMTQSPDSLAVSLGERATINCKSSTGAVTTSNYANWVQQKPGQPPKGLIGGTNKRAPGVPDRFSGSGS
GTDFTLTISSLQAEDVAVYYCALWYSNLWVFGGGTKVEIKGS

Figure 3Z

XENP11922 H1_L1.31

SEQ ID NO. 203.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTDSGAQPEDEADYYCALWYSNHWVFGGGTKLTVLGSHHHHHH

SEQ ID NO. 204.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTDSGAQPEDEADYYCALWYSNHWVFGGGTKLTVL

SEQ ID NO. 205.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 206.
QAVVTQEPSLTVSPGGTVTLTCGSSTGAVTTSNYANWVQQKPGQAPRGLIGGTNKRAPGVPARFSGSLLG
GKAALTDSGAQPEDEADYYCALWYSNHWVFGGGTKLTVL

XENP11923 H1_L1.32

SEQ ID NO. 207.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQEKPGQAPRGLIGGTNKRAPGVPARFSGSLLG
GKAALTLSGAQPEDEAEYYCALWYSNLWVFGGGTKLTVLGSHHHHHH

SEQ ID NO. 208.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQEKPGQAPRGLIGGTNKRAPGVPARFSGSLLG
GKAALTLSGAQPEDEAEYYCALWYSNLWVFGGGTKLTVL

SEQ ID NO. 209.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 210.
QAVVTQEPSLTVSPGGTVTLTCGSSTGAVTTSNYANWVQEKPGQAPRGLIGGTNKRAPGVPARFSGSLLG
GKAALTLSGAQPEDEAEYYCALWYSNLWVFGGGTKLTVL

Figure 3AA

XENP12107 H1.38_L1.4

SEQ ID NO. 211.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTATYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 212.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTATYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 213.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTATYYCVRHGNFGNSYVSWFAYWGQGTLVTVSS

SEQ ID NO. 214.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP12108 H1_L1.33

SEQ ID NO. 215.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTLSGAQPEDEAEYYCALWYSNLWVFGGGTKLTVLGSHHHHHH

SEQ ID NO. 216.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTLSGAQPEDEAEYYCALWYSNLWVFGGGTKLTVL

SEQ ID NO. 217.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 218.
QAVVTQEPSLTVSPGGTVTLTCGSSTGAVTTSNYANWVQQKPGKAPRGLIGGTNKRAPGVPARFSGSLLG
GKAALTLSGAQPEDEAEYYCALWYSNLWVFGGGTKLT

Figure 3BB

XENP12109 H1_L1.34

SEQ ID NO. 219.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGTAPRGLIGGTNKRAPGVPARFSGSLLG
GKAALTLSGAQPEDEAEYYCALWYSNLWVFGGGTKLTVLGSHHHHHH

SEQ ID NO. 220.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGTAPRGLIGGTNKRAPGVPARFSGSLLG
GKAALTLSGAQPEDEAEYYCALWYSNLWVFGGGTKLTVL

SEQ ID NO. 221.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 222.
QAVVTQEPSLTVSPGGTVTLTCGSSTGAVTTSNYANWVQQKPGTAPRGLIGGTNKRAPGVPARFSGSLLG
GKAALTLSGAQPEDEAEYYCALWYSNLWVFGGGTKLTVL

XENP12110 H1_L1.35

SEQ ID NO. 223.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGSPPRGLIGGTNKRAPGVPARFSGSLLG
GKAALTLSGAQPEDEAEYYCALWYSNLWVFGGGTKLTVLGSHHHHHH

SEQ ID NO. 224.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGSPPRGLIGGTNKRAPGVPARFSGSLLG
GKAALTLSGAQPEDEAEYYCALWYSNLWVFGGGTKLTVL

SEQ ID NO. 225.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 226.
QAVVTQEPSLTVSPGGTVTLTCGSSTGAVTTSNYANWVQQKPGSPPRGLIGGTNKRAPGVPARFSGSLLG
GKAALTLSGAQPEDEAEYYCALWYSNLWVFGGGTKLTVL

Figure 3CC

XENP12111 H1_L1.36

SEQ ID NO. 227.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQPPRGLIGGTNKRAPGVPARFSGSLLG
GKAALTLSGAQPEDEAEYYCALWYSNLWVFGGGTKLTVLGSHHHHHH

SEQ ID NO. 228.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQPPRGLIGGTNKRAPGVPARFSGSLLG
GKAALTLSGAQPEDEAEYYCALWYSNLWVFGGGTKLTVL

SEQ ID NO. 229.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 230.
QAVVTQEPSLTVSPGGTVTLTCGSSTGAVTTSNYANWVQQKPGQPPRGLIGGTNKRAPGVPARFSGSLLG
GKAALTLSGAQPEDEAEYYCALWYSNLWVFGGGTKLTVL

XENP12112 H1_L1.37

SEQ ID NO. 231.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQGPRGLIGGTNKRAPGVPARFSGSLLG
GKAALTLSGAQPEDEAEYYCALWYSNLWVFGGGTKLTVLGSHHHHHH

SEQ ID NO. 232.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQGPRGLIGGTNKRAPGVPARFSGSLLG
GKAALTLSGAQPEDEAEYYCALWYSNLWVFGGGTKLTVL

SEQ ID NO. 233.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 234.
QAVVTQEPSLTVSPGGTVTLTCGSSTGAVTTSNYANWVQQKPGQGPRGLIGGTNKRAPGVPARFSGSLLG
GKAALTLSGAQPEDEAEYYCALWYSNLWVFGGGTKLTVL

Figure 3DD

XENP12113 H1_L1.38

SEQ ID NO. 235.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTLSGAQPEDEAEYYCALWYSNLWVFGGGTKLTVLGSHHHHHH

SEQ ID NO. 236.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTLSGAQPEDEAEYYCALWYSNLWVFGGGTKLTVL

SEQ ID NO. 237.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 238.
QAVVTQEPSLTVSPGGTVTLTCGSSTGAVTTSNYANWVQQKPGQSPRGLIGGTNKRAPGVPARFSGSLLG
GKAALTLSGAQPEDEAEYYCALWYSNLWVFGGGTKLTVL

XENP12114 H1_L1.39

SEQ ID NO. 239.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQDPRGLIGGTNKRAPGVPARFSGSLLG
GKAALTLSGAQPEDEAEYYCALWYSNLWVFGGGTKLTVLGSHHHHHH

SEQ ID NO. 240.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQDPRGLIGGTNKRAPGVPARFSGSLLG
GKAALTLSGAQPEDEAEYYCALWYSNLWVFGGGTKLTVL

SEQ ID NO. 241.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 242.
QAVVTQEPSLTVSPGGTVTLTCGSSTGAVTTSNYANWVQQKPGQDPRGLIGGTNKRAPGVPARFSGSLLG
GKAALTLSGAQPEDEAEYYCALWYSNLWVFGGGTKLTVL

Figure 3EE

XENP12131 H1.30_L1.4

SEQ ID NO. 243.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 244.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 245.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 246.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP12132 H1.31_L1.4

SEQ ID NO. 247.
EVQLVESGGGLVQPGGSLRLSCAASGFTFSTYAMSWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 248.
EVQLVESGGGLVQPGGSLRLSCAASGFTFSTYAMSWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 249.
EVQLVESGGGLVQPGGSLRLSCAASGFTFSTYAMSWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 250.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 3FF

XENP12133 H1.32_L1.4

SEQ ID NO. 251.
EVQLVESGGGLVQPGGSLRLSCAASGFTFSTYAMNWVRQAPGKGLEWVGRIRSKANNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 252.
EVQLVESGGGLVQPGGSLRLSCAASGFTFSTYAMNWVRQAPGKGLEWVGRIRSKANNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 253.
EVQLVESGGGLVQPGGSLRLSCAASGFTFSTYAMNWVRQAPGKGLEWVGRIRSKANNYATYYADSVKGRF
TISRDDSKNTLYLQMNSLRAEDTAVYYCVRHGNFGDSYVSWFAYWGQGTLVTVSS

SEQ ID NO. 254.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP12134 H1.33_L1.4

SEQ ID NO. 255.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFDYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 256.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFDYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 257.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFDYWGQGTLVTVSS

SEQ ID NO. 258.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 3GG

XENP12135 H1.34_L1.4

SEQ ID NO. 259.
EVQLVESGGGLVQPGGSLRLSCAASGFTFSTYAMSWVRQAPGKGLEWVGRIRSKANNYATYYADSVKGRF
TISRDDSKNTLYLQMNSLRAEDTAVYYCVRHGNFGDSYVSWFDYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 260.
EVQLVESGGGLVQPGGSLRLSCAASGFTFSTYAMSWVRQAPGKGLEWVGRIRSKANNYATYYADSVKGRF
TISRDDSKNTLYLQMNSLRAEDTAVYYCVRHGNFGDSYVSWFDYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 261.
EVQLVESGGGLVQPGGSLRLSCAASGFTFSTYAMSWVRQAPGKGLEWVGRIRSKANNYATYYADSVKGRF
TISRDDSKNTLYLQMNSLRAEDTAVYYCVRHGNFGDSYVSWFDYWGQGTLVTVSS

SEQ ID NO. 262.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP12136 H1.35_L1.4

SEQ ID NO. 263.
EVQLVESGGEVKKPGESLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 264.
EVQLVESGGEVKKPGESLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 265.
EVQLVESGGEVKKPGESLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 266.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 3HH

XENP12137 H1.36_L1.4

SEQ ID NO. 267.
EVQLVESGGGLVQPGGSLRLSCAASGFTFNTYAMNWVRQAPGKGLEWVGRIRSNGGSTYYADSVKGRFTI
SRDDSKNTLYLQMNSLRAEDTAVYYCVRHGNFGNSYVSWFAYWGQGTLVTVSSGGGGSGGGGSGGGGSQA
VVTQEPSLTVSPGGTVTLTCGSSTGAVTTSNYANWVQQKPGQAPRGLIGGTNKRAPGVPARFSGSLLGGK
AALTLSGAQPEDEAEYYCALWYSNLWVFGGGTKLTVLGSHHHHHH

SEQ ID NO. 268.
EVQLVESGGGLVQPGGSLRLSCAASGFTFNTYAMNWVRQAPGKGLEWVGRIRSNGGSTYYADSVKGRFTI
SRDDSKNTLYLQMNSLRAEDTAVYYCVRHGNFGNSYVSWFAYWGQGTLVTVSSGGGGSGGGGSGGGGSQA
VVTQEPSLTVSPGGTVTLTCGSSTGAVTTSNYANWVQQKPGQAPRGLIGGTNKRAPGVPARFSGSLLGGK
AALTLSGAQPEDEAEYYCALWYSNLWVFGGGTKLTVL

SEQ ID NO. 269.
EVQLVESGGGLVQPGGSLRLSCAASGFTFNTYAMNWVRQAPGKGLEWVGRIRSNGGSTYYADSVKGRFTI
SRDDSKNTLYLQMNSLRAEDTAVYYCVRHGNFGNSYVSWFAYWGQGTLVTVSS

SEQ ID NO. 270.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP12138 H1.37_L1.4

SEQ ID NO. 271.
EVQLVESGGGLVQPGGSLRLSCAASGFTFNTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 272.
EVQLVESGGGLVQPGGSLRLSCAASGFTFNTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 273.
EVQLVESGGGLVQPGGSLRLSCAASGFTFNTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 274.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 3II

XENP12139 H1.37_L1.32

SEQ ID NO. 275.
EVQLVESGGGLVQPGGSLRLSCAASGFTFNTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQEKPGQAPRGLIGGTNKRAPGVPARFSGSLLG
GKAALTLSGAQPEDEAEYYCALWYSNLWVFGGGTKLTVLGSHHHHHH

SEQ ID NO. 276.
EVQLVESGGGLVQPGGSLRLSCAASGFTFNTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQEKPGQAPRGLIGGTNKRAPGVPARFSGSLLG
GKAALTLSGAQPEDEAEYYCALWYSNLWVFGGGTKLTVL

SEQ ID NO. 277.
EVQLVESGGGLVQPGGSLRLSCAASGFTFNTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 278.
QAVVTQEPSLTVSPGGTVTLTCGSSTGAVTTSNYANWVQEKPGQAPRGLIGGTNKRAPGVPARFSGSLLG
GKAALTLSGAQPEDEAEYYCALWYSNLWVFGGGTKLTVL

XENP12149 H1_L1.40

SEQ ID NO. 279.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVLGSHHHHHH

SEQ ID NO. 280.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

SEQ ID NO. 281.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 282.
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

Figure 3JJ

XENP12213 H1.30_L1.40

SEQ ID NO. 283.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVLGSHHHHHH

SEQ ID NO. 284.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

SEQ ID NO. 285.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 286.
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

XENP12214 H1.8_L1.40

SEQ ID NO. 287.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVLGSHHHHHH

SEQ ID NO. 288.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

SEQ ID NO. 289.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 290.
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

Figure 3KK

XENP12215 H1.39_L1.40

SEQ ID NO. 291.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVLGSHHHHHH

SEQ ID NO. 292.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

SEQ ID NO. 293.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 294.
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

XENP12216 H1.40_L1.40

SEQ ID NO. 295.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVLGSHHHHHH

SEQ ID NO. 296.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

SEQ ID NO. 297.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 298.
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

Figure 3LL

XENP12217 H1.30_L1.41

SEQ ID NO. 299.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVLGSHHHHHH

SEQ ID NO. 300.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

SEQ ID NO. 301.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 302.
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

XENP12218 H1.8_L1.41

SEQ ID NO. 303.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVLGSHHHHHH

SEQ ID NO. 304.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

SEQ ID NO. 305.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 306.
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

Figure 3MM

XENP12219 H1.39_L1.41

SEQ ID NO. 307.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVLGSHHHHHH

SEQ ID NO. 308.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

SEQ ID NO. 309.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 310.
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

XENP12220 H1.40_L1.41

SEQ ID NO. 311.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVLGSHHHHHH

SEQ ID NO. 312.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

SEQ ID NO. 313.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 314.
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

Figure 3NN

XENP12221 H1.30_L1.42

SEQ ID NO. 315.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVLGSHHHHHH

SEQ ID NO. 316.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

SEQ ID NO. 317.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 318.
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

XENP12222 H1.8_L1.42

SEQ ID NO. 319.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVLGSHHHHHH

SEQ ID NO. 320.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

SEQ ID NO. 321.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 322.
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

Figure 3OO

XENP12223 H1.39_L1.42

SEQ ID NO. 323.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVLGSHHHHHH

SEQ ID NO. 324.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

SEQ ID NO. 325.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 326.
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

XENP12224 H1.40_L1.42

SEQ ID NO. 327.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVLGSHHHHHH

SEQ ID NO. 328.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

SEQ ID NO. 329.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 330.
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

Figure 3PP

XENP12225 H1.30_L1.43

SEQ ID NO. 331.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVLGSHHHHHH

SEQ ID NO. 332.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

SEQ ID NO. 333.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 334.
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

XENP12226 H1.8_L1.43

SEQ ID NO. 335.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVLGSHHHHHH

SEQ ID NO. 336.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

SEQ ID NO. 337.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 338.
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

Figure 3QQ

XENP12227 H1.39_L1.43

SEQ ID NO. 339.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVLGSHHHHHH

SEQ ID NO. 340.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

SEQ ID NO. 341.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 342.
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

XENP12228 H1.40_L1.43

SEQ ID NO. 343.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVLGSHHHHHH

SEQ ID NO. 344.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

SEQ ID NO. 345.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 346.
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

Figure 3RR

XENP12229 H1.30_L1.44

SEQ ID NO. 347.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVLGSHHHHHH

SEQ ID NO. 348.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

SEQ ID NO. 349.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 350.
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

XENP12230 H1.8_L1.44

SEQ ID NO. 351.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVLGSHHHHHH

SEQ ID NO. 352.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

SEQ ID NO. 353.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 354.
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

Figure 3SS

XENP12231 H1.39_L1.44

SEQ ID NO. 355.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVLGSHHHHHH

SEQ ID NO. 356.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

SEQ ID NO. 357.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 358.
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

XENP12232 H1.40_L1.44

SEQ ID NO. 359.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVLGSHHHHHH

SEQ ID NO. 360.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

SEQ ID NO. 361.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 362.
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

Figure 3TT

XENP12233 H1.30_L1.45

SEQ ID NO. 363.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVLGSHHHHHH

SEQ ID NO. 364.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

SEQ ID NO. 365.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 366.
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

XENP12234 H1.8_L1.45

SEQ ID NO. 367.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVLGSHHHHHH

SEQ ID NO. 368.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

SEQ ID NO. 369.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 370.
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

Figure 3UU

XENP12235 H1.39_L1.45

SEQ ID NO. 371.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVLGSHHHHHH

SEQ ID NO. 372.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

SEQ ID NO. 373.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 374.
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

XENP12236 H1.40_L1.45

SEQ ID NO. 375.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVLGSHHHHHH

SEQ ID NO. 376.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

SEQ ID NO. 377.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 378.
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

Figure 3VV

XENP12237 H1.30_L1.46

SEQ ID NO. 379.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVLGSHHHHHH

SEQ ID NO. 380.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

SEQ ID NO. 381.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 382.
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

XENP12238 H1.8_L1.46

SEQ ID NO. 383.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVLGSHHHHHH

SEQ ID NO. 384.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

SEQ ID NO. 385.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 386.
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

Figure 3WW

XENP12239 H1.39_L1.46

SEQ ID NO. 387.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVLGSHHHHHH

SEQ ID NO. 388.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

SEQ ID NO. 389.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 390.
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

XENP12240 H1.40_L1.46

SEQ ID NO. 391.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVLGSHHHHHH

SEQ ID NO. 392.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

SEQ ID NO. 393.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 394.
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

Figure 3XX

XENP12241 H1.30_L1.47

SEQ ID NO. 395.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVLGSHHHHHH

SEQ ID NO. 396.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

SEQ ID NO. 397.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 398.
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

XENP12242 H1.8_L1.47

SEQ ID NO. 399.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVLGSHHHHHH

SEQ ID NO. 400.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

SEQ ID NO. 401.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 402.
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

Figure 3YY

XENP12243 H1.39_L1.47

SEQ ID NO. 403.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVLGSHHHHHH

SEQ ID NO. 404.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

SEQ ID NO. 405.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 406.
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

XENP12244 H1.40_L1.47

SEQ ID NO. 407.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVLGSHHHHHH

SEQ ID NO. 408.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

SEQ ID NO. 409.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 410.
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

Figure 4A

Optimized scFv CD3 variable regions

| Xen # | vhCDR1 | vhCDR2 | vhCDR3 | vlCDR1 | vlCDR2 | vlCDR3 |
|---|---|---|---|---|---|---|
| XENP11502 H1_L1.4 SEQ ID NO: 4 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11794 H1.3_L1.4 SEQ ID NO: 8 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11795 H1.4_L1.4 SEQ ID NO: 12 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11796 H1.5_L1.4 SEQ ID NO: 16 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11801 H1.6_L1.4 SEQ ID NO: 20 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11802 H1.7_L1.4 SEQ ID NO: 24 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11803 H1.8_L1.4 SEQ ID NO: 28 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11804 H1.9_L1.4 SEQ ID NO: 32 | TYAMH SEQ ID NO: 432 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11805 H1.10_L1.4 SEQ ID NO: 36 | TYAMS SEQ ID NO: 412 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11806 H1.11_L1.4 SEQ ID NO: 40 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11807 H1.12_L1.4 SEQ ID NO: 44 | TYAMN SEQ ID NO: 411 | RIRSKANNYATYYADSVKG SEQ ID NO: 414 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |

Figure 4B

| Xen # | vhCDR1 | vhCDR2 | vhCDR3 | vlCDR1 | vlCDR2 | vlCDR3 |
|---|---|---|---|---|---|---|
| XENP11808 H1.13_L1.4 SEQ ID NO: 48 | TYAMN SEQ ID NO: 411 | RIRSKANSYATYYADSVKG SEQ ID NO: 434 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11809 H1.14_L1.4 SEQ ID NO: 52 | TYAMN SEQ ID NO: 411 | RIRSKYNNYATAYADSVKG SEQ ID NO: 478 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11810 H1.15_L1.4 SEQ ID NO: 56 | TYAMN SEQ ID NO: 411 | RIRSKYNNYATYYAASVKG SEQ ID NO: 479 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11811 H1.16_L1.4 SEQ ID NO: 60 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11812 H1.17_L1.4 SEQ ID NO: 64 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11813 H1.18_L1.4 SEQ ID NO: 68 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11814 H1.19_L1.4 SEQ ID NO: 72 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11815 H1.20_L1.4 SEQ ID NO: 76 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11816 H1.21_L1.4 SEQ ID NO: 80 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11817 H1.22_L1.4 SEQ ID NO: 84 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11818 H1.23_L1.4 SEQ ID NO: 88 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11819 H1.24_L1.4 SEQ ID NO: 92 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNLWV SEQ ID NO: 430 |

Figure 4C

| Xen # | vhCDR1 | vhCDR2 | vhCDR3 | vlCDR1 | vlCDR2 | vlCDR3 |
|---|---|---|---|---|---|---|
| XENP11820 H1.25_L1.4 SEQ ID NO: 96 | TYAMN SEQ ID NO: 411 | RIRSKYNNYATYYADSVKG SEQ ID NO: 413 | HGNFGQSYVSWFAY SEQ ID NO: 418 | GSSTGAVTTSNYAN SEQ ID NO: 420 | GTNKRAP SEQ ID NO: 425 | ALWYSNLWV SEQ ID NO: 430 |
| XENP11821 H1.26_L1.4 SEQ ID NO: 100 | TYAMN SEQ ID NO: 411 | RIRSKYNNYATYYADSVKG SEQ ID NO: 413 | HGNFGNTYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11822 H1.27_L1.4 SEQ ID NO: 104 | TYAMN SEQ ID NO: 411 | RIRSKYNNYATYYADSVKG SEQ ID NO: 413 | HGNFGNSYVSWFDY SEQ ID NO: 480 | GSSTGAVTTSNYAN SEQ ID NO: 420 | GTNKRAP SEQ ID NO: 425 | ALWYSNLWV SEQ ID NO: 430 |
| XENP11823 H1.23_L1.4 SEQ ID NO: 108 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11824 H1.29_L1.30 SEQ ID NO: 112 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11825 H1_L1.10 SEQ ID NO: 116 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11826 H1_L1.11 SEQ ID NO: 120 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11827 H1_L1.12 SEQ ID NO: 124 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11828 H1_L1.13 SEQ ID NO: 128 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11829 H1_L1.14 SEQ ID NO: 132 | TYAMN SEQ ID NO: 411 | RIRSKYNNYATYYADSVKG SEQ ID NO: 413 | HGNFGNSYVSWFAY SEQ ID NO: 416 | GSSTGAVTSNYAN SEQ ID NO: 421 | GTNKRAP SEQ ID NO: 425 | ALWYSNLWV SEQ ID NO: 430 |
| XENP11830 H1_L1.15 SEQ ID NO: 136 | TYAMN SEQ ID NO: 411 | RIRSKYNNYATYYADSVKG SEQ ID NO: 413 | HGNFGNSYVSWFAY SEQ ID NO: 416 | GSSTGAVTSGHYAN SEQ ID NO: 422 | GTNKRAP SEQ ID NO: 425 | ALWYSNLWV SEQ ID NO: 430 |
| XENP11831 H1_L1.16 SEQ ID NO: 140 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | DTNKRAP SEQ ID NO: 426 | ALWYSNLWV SEQ ID NO: 430 |

Figure 4D

| Xen # | vhCDR1 | vhCDR2 | vhCDR3 | vlCDR1 | vlCDR2 | vlCDR3 |
|---|---|---|---|---|---|---|
| XENP11832 H1_L1.17 SEQ ID NO: 144 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNNRAP SEQ ID NO: 427 | ALWYSNLWV SEQ ID NO: 430 |
| XENP11833 H1_L1.18 SEQ ID NO: 148 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAS SEQ ID NO: 428 | ALWYSNLWV SEQ ID NO: 430 |
| XENP11834 H1_L1.19 SEQ ID NO: 152 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTSNKHS SEQ ID NO: 482 | ALWYSNLWV SEQ ID NO: 430 |
| XENP11835 H1_L1.20 SEQ ID NO: 156 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11836 H1_L1.21 SEQ ID NO: 160 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11837 H1_L1.22 SEQ ID NO: 164 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11838 H1_L1.23 SEQ ID NO: 168 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11839 H1_L1.24 SEQ ID NO: 172 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11840 H1_L1.25 SEQ ID NO: 176 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11841 H1_L1.26 SEQ ID NO: 180 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11842 H1_L1.27 SEQ ID NO: 184 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | LLWYSNLWV SEQ ID NO: 417 |
| XENP11843 H1_L1.28 SEQ ID NO: 188 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |

Figure 4E

| Xen # | vhCDR1 | vhCDR2 | vhCDR3 | vlCDR1 | vlCDR2 | vlCDR3 |
|---|---|---|---|---|---|---|
| XENP11844 H1_L1.29 SEQ ID NO: 192 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11920 H1_L3.1 SEQ ID NO: 196 | TYAMN SEQ ID NO: 411 | RIRSKYNNYATYYADSVKG SEQ ID NO: 413 | HGNFGNSYVSWFAY SEQ ID NO: 416 | RSSTGAVTTSNYAN SEQ ID NO: 423 | GTNKRAP SEQ ID NO: 425 | ALWYSNLWV SEQ ID NO: 430 |
| XENP11921 H1_L5.1 SEQ ID NO: 200 | TYAMN SEQ ID NO: 411 | RIRSKYNNYATYYADSVKG SEQ ID NO: 413 | HGNFGNSYVSWFAY SEQ ID NO: 416 | KSSTGAVTTSNYAN SEQ ID NO: 424 | GTNKRAP SEQ ID NO: 425 | ALWYSNLWV SEQ ID NO: 430 |
| XENP11922 H1_L1.31 SEQ ID NO: 204 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP11923 H1_L1.32 SEQ ID NO: 208 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12107 H1.38_L1.4 SEQ ID NO: 212 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12108 H1_L1.33 SEQ ID NO: 216 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12109 H1_L1.34 SEQ ID NO: 220 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12110 H1_L1.35 SEQ ID NO: 224 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12111 H1_L1.36 SEQ ID NO: 228 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12112 H1_L1.37 SEQ ID NO: 232 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12113 H1_L1.38 SEQ ID NO: 236 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |

Figure 4F

| Xen # | vhCDR1 | vhCDR2 | vhCDR3 | vlCDR1 | vlCDR2 | vlCDR3 |
|---|---|---|---|---|---|---|
| XENP12114 H1_L1.39 SEQ ID NO: 240 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12131 H1.30_L1.4 SEQ ID NO: 244 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNLWV SEQ ID NO: 430 |
| XENP12132 H1.31_L1.4 SEQ ID NO: 248 | TYAMS SEQ ID NO: 412 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNLWV SEQ ID NO: 430 |
| XENP12133 H1.32_L1.4 SEQ ID NO: 252 | TYAMN SEQ ID NO: 411 | RIRSKANNYATYYADSVKG SEQ ID NO: 414 | HGNFGDSYVSWFAY SEQ ID NO: 417 | GSSTGAVTTSNYAN SEQ ID NO: 420 | GTNKRAP SEQ ID NO: 425 | ALWYSNLWV SEQ ID NO: 430 |
| XENP12134 H1.33_L1.4 SEQ ID NO: 256 | TYAMS SEQ ID NO: 412 | RIRSKANNYATYYADSVKG SEQ ID NO: 414 | HGNFGDSYVSWFDY SEQ ID NO: 419 | GSSTGAVTTSNYAN SEQ ID NO: 420 | GTNKRAP SEQ ID NO: 425 | ALWYSNLWV SEQ ID NO: 430 |
| XENP12135 H1.34_L1.4 SEQ ID NO: 260 | TYAMN SEQ ID NO: 411 | RIRSKYNNYATYYADSVKG SEQ ID NO: 413 | HGNFGDSYVSWFDY SEQ ID NO: 419 | GSSTGAVTTSNYAN SEQ ID NO: 420 | GTNKRAP SEQ ID NO: 425 | ALWYSNLWV SEQ ID NO: 430 |
| XENP12136 H1.35_L1.4 SEQ ID NO: 264 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12137 H1.36_L1.4 SEQ ID NO: 268 | TYAMN SEQ ID NO: 411 | RIRSNGGSTYYADSVKG SEQ ID NO: 415 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12138 H1.37_L1.4 SEQ ID NO: 272 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12139 H1.37_L1.32 SEQ ID NO: 276 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12149 H1_L1.40 SEQ ID NO: 280 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12213 H1.30_L1.40 SEQ ID NO: 284 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |

Figure 4G

| Xen # | vhCDR1 | vhCDR2 | vhCDR3 | vlCDR1 | vlCDR2 | vlCDR3 |
|---|---|---|---|---|---|---|
| XENP12214 H1.8_L1.40 SEQ ID NO: 288 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12215 H1.39_L1.40 SEQ ID NO: 292 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12216 H1.40_L1.40 SEQ ID NO: 296 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12217 H1.30_L1.41 SEQ ID NO: 300 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12218 H1.8_L1.41 SEQ ID NO: 304 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12219 H1.39_L1.41 SEQ ID NO: 308 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12220 H1.40_L1.41 SEQ ID NO: 312 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12221 H1.30_L1.42 SEQ ID NO: 316 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12222 H1.8_L1.42 SEQ ID NO: 320 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12223 H1.39_L1.42 SEQ ID NO: 324 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12224 H1.40_L1.42 SEQ ID NO: 328 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12225 H1.30_L1.43 SEQ ID NO: 332 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |

Figure 4H

| Xen # | vhCDR1 | vhCDR2 | vhCDR3 | vlCDR1 | vlCDR2 | vlCDR3 |
|---|---|---|---|---|---|---|
| XENP12226 H1.8_L1.43 SEQ ID NO: 336 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12227 H1.39_L1.43 SEQ ID NO: 340 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12228 H1.40_L1.43 SEQ ID NO: 344 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12229 H1.30_L1.44 SEQ ID NO: 348 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12230 H1.8_L1.44 SEQ ID NO: 352 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12231 H1.39_L1.44 SEQ ID NO: 356 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12232 H1.40_L1.44 SEQ ID NO: 360 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12233 H1.30_L1.45 SEQ ID NO: 364 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12234 H1.8_L1.45 SEQ ID NO: 368 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12235 H1.39_L1.45 SEQ ID NO: 372 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12236 H1.40_L1.45 SEQ ID NO: 376 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12237 H1.30_L1.46 SEQ ID NO: 380 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |

Figure 4I

| Xen # | vhCDR1 | vhCDR2 | vhCDR3 | vlCDR1 | vlCDR2 | vlCDR3 |
|---|---|---|---|---|---|---|
| XENP12238 H1.8_L1.46 SEQ ID NO: 384 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12239 H1.39_L1.46 SEQ ID NO: 388 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12240 H1.40_L1.46 SEQ ID NO: 392 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12241 H1.30_L1.47 SEQ ID NO: 396 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12242 H1.8_L1.47 SEQ ID NO: 400 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12243 H1.39_L1.47 SEQ ID NO: 404 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12244 H1.40_L1.47 SEQ ID NO: 408 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP ?? SEQ ID NO: 1 and 2 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| Consensus sequences | TYAMXaa1, wherein Xaa1 is N, S or H (SEQ ID NO:435) | R-I-R-S-K-Xaa1-N-Xaa2-Y-A-T-Xaa3-Y-Y-A-Xaa4-S-V-K-G, wherein Xaa1 is Y or A, Xaa2 is N or S, Xaa3 is Y or A and Xaa4 is D or A (SEQ ID NO:436) | H-G-N-F-G-Xaa1-S-Y-V-S-W-F-Xaa2-Y, wherein Xaa1 is N, D or Q and Xaa2 is A or D (SEQ ID NO:437) | Xaa1-S-S-T-G-A-V-T-Xaa2-Xaa3-Xaa4-Y-A-N, wherein Xaa1 is G, R or K, Xaa2 is T or S, Xaa3 is S or G and Xaa4 is N or H, (SEQ ID NO:438) | Xaa1-T-N-Xaa2-R-A-Xaa3, wherein Xaa1 is G or D, Xaa2 is K or N, and Xaa3 is P or S (SEQ ID NO:439) | Xaa1-L-W-Y-S-N-Xaa2-W-V, wherein Xaa1 is A or L and Xaa2 is L or H (SEQ ID NO:440) |

Figure 5

Positive charged scFv linkers

| Name | Sequence | Length | Charge | SEQ ID NO: |
|---|---|---|---|---|
| Gly-Ser 15 | GGGGSGGGGSGGGGS | 15 | 0 | 441 |
| Whitlow linker | GSTSGSGKPGSGEGSTKG | 18 | +1 | 442 |
| 6paxA_1 (+A) | IRPRAIGGSKPRVA | 14 | +4 | 443 |
| +B | GKGGSGKGGSGKGGS | 15 | +3 | 444 |
| +C | GGKGSGGKGSGGKGS | 15 | +3 | 445 |
| +D | GGGKSGGGKSGGGKS | 15 | +3 | 446 |
| +E | GKGKSGKGKSGKGKS | 15 | +6 | 447 |
| +F | GGGKSGGKGSGKGGS | 15 | +3 | 448 |
| +G | GKPGSGKPGSGKPGS | 15 | +3 | 449 |
| +H | GKPGSGKPGSGKPGSGKPGS | 20 | +4 | 450 |
| +I | GKGKSGKGKSGKGKSGKGKS | 20 | +8 | 451 |

Negative charged scFv linkers

| Name | Sequence | Length | Charge | |
|---|---|---|---|---|
| Gly-Ser 15 | GGGGSGGGGSGGGGSGGGGS | 20 | 0 | 452 |
| 3hsc_2 (-A) | STAGDTHLGGEDFD | 14 | -4 | 453 |
| -B | GEGGSGEGGSGEGGS | 15 | -3 | 454 |
| -C | GGEGSGGEGSGGEGS | 15 | -3 | 455 |
| -D | GGGESGGGESGGGES | 15 | -3 | 456 |
| -E | GEGESGEGESGEGES | 15 | -6 | 457 |
| -F | GGGESGGEGSGEGGS | 15 | -3 | 458 |
| -G | GEGESGEGESGEGESGEGES | 20 | -8 | 459 |

Figure 6A

Preferred steric variants that favor Fc heterodimerization.

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |
| Y349T | S364H |
| T394F | F405A |
| Y349T/T394F | S364H/F405A |
| K370E | T411K |
| K370E/T411D | T411K |
| K370E/T411E | K370R/T411K |
| L368E/K409E | L368K |
| Y349T/T411E | S364H/D401K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |

Figure 6B

| Monomer 1 | Monomer 2 |
|---|---|
| L368D/K370S | S364K |
| L368D/K370S | S364K/E357L |
| L368D/K370S | S364K/E357Q |
| T411E/K360E/Q362E | D401K |
| L368E/K370S | S364K |
| K370S | S364K |
| L368E/K370S | S364K/E357Q |
| K370S | S364K/E357Q |
| L368E/K370S | S364K |
| K370S | S364K |
| L368E/K370S | S364K/E357Q |
| K370S | S364K/E357Q |

Figure 6C

| Monomer 1 | Monomer 2 |
|---|---|
| ISO(-) side | ISO(+) or ISO(++RR)) side |
| T411E | D401K |
| T411E K360D | D401K |
| T411E K360E | D401K |
| T411E Q362E | D401K |
| T411E N390D | D401K |
| T411E | D401K Q347K |
| T411E | D401K Q347R |
| T411E K360D Q362E | D401K |
| T411E K360E Q362E | D401K |
| T411E K360E N390D | D401K |
| T411E Q362E N390D | D401K |
| T411E Q347R | D401K K360D |
| T411E Q347R | D401K K360E |
| T411E K360 | D401K Q347K |
| T411E K360D | D401K Q347R |
| T411E K360E | D401K Q347K |
| T411E K360E | D401K Q347R |
| T411E S364K | D401K K370S |
| T411E K370S | D401K S364K |
| Q347E | E357Q |
| Q347E | E357Q Q362K |
| K360D Q362E | Q347R |
| K360D Q362E | D401K |
| K360D Q362E | Q347R D401K |
| K360E Q362E | Q347R |
| K360E Q362E | D401K |
| K360E Q362E | Q347R D401K |
| Q362E N390D | D401K |
| Q347E K360D | D401N |
| K360D | Q347R N390K |
| K360D | N390KD401N |
| K360E | Y349H |
| K370S Q347E | S364K |
| K370S E357L | S364K |
| K370S E357Q | S364K |
| K370S Q347E E357L | S364K |
| K370S Q347E E357Q | S364K |
| L368D K370S Q347E | S364K |
| L368D K370S E357L | S364K |
| L368D K370S E357Q | S364K |
| L368D K370S Q347E E357L | S364K |
| L368D K370S Q347E E357Q | S364K |
| L368E K370S Q347E | S364K |
| L368E K370S E357L | S364K |
| L368E K370S E357Q | S364K |
| L368E K370S Q347E E357L | S364K |
| L368E K370S Q347E E357Q | S364K |
| L368D K370T Q347E | S364K |
| L368D K370T E357L | S364K |
| L368D K370T E357Q | S364K |

Figure 6D

| Monomer 1 | Monomer 2 |
|---|---|
| L368D K370T Q347E E357L | S364K |
| L368D K370T Q347E E357Q | S364K |
| L368E K370T Q347E | S364K |
| L368E K370T E357L | S364K |
| L368E K370T E357Q | S364K |
| L368E K370T Q347E E357L | S364K |
| L368E K370T Q347E E357Q | S364K |
| T411E Q362E | D401K T411K |
| T411E N390D | D401K T411K |
| T411E Q362E | D401R T411R |
| T411E N390D | D401R T411R |

Figure 7

| XENP | Heterodimer-skewing variant, Chain 1 | Heterodimer-skewing variant, Chain 2 | Heterodimer Yield (%) | CH3 Tm (°C) |
|---|---|---|---|---|
| 12757 | none | none | 52.7 | 83.1 |
| 12758 | L368D/K370S | S364K | 94.4 | 76.6 |
| 12759 | L368D/K370S | S364K/E357L | 90.2 | 77.2 |
| 12760 | L368D/K370S | S364K/E357Q | 95.2 | 77.5 |
| 12761 | T411E/K360E/Q362E | D401K | 85.6 | 80.6 |
| 12496 | L368E/K370S | S364K | 91.5 | n.d. |
| 12511 | K370S | S364K | 59.9 | n.d. |
| 12840 | L368E/K370S | S364K/E357Q | 59.5 | n.d. |
| 12841 | K370S | S364K/E357Q | 90.4 | n.d. |
| 12894 | L368E/K370S | S364K | 41.0 | n.d. |
| 12895 | K370S | S364K | 49.3 | n.d. |
| 12896 | L368E/K370S | S364K/E357Q | 73.9 | n.d. |
| 12901 | K370S | S364K/E357Q | 87.9 | n.d. |

Figure 9
Ablation Variants

| Variant | Variant(s), cont. |
|---|---|
| G236R | P329K |
| S239G | A330L |
| S239K | A330S/P331S |
| S239Q | I332K |
| S239R | I332R |
| V266D | V266D/A327Q |
| S267K | V266D/P329K |
| S267R | S267R/A327Q |
| H268K | S267R/P329K |
| E269R | G236R/L328R |
| 299R | E233P/L234V/L235A/G236del/S239K |
| 299K | E233P/L234V/L235A/G236del/S267K |
| K322A | E233P/L234V/L235A/G236del/S239K/A327G |
| A327G | E233P/L234V/L235A/G236del/S267K/A327G |
| A327L | E233P/L234V/L235A/G236del |
| A327N | S239K/S267K |
| A327Q | |
| L328E | |
| L328R | |
| P329A | |
| P329H | |

Figure 10

| XENP | Heterodimer-skewing variant, Chain 1 | Heterodimer-skewing variant, Chain 2 | Heterodimer Yield (%) | CH3 Tm (°C) |
|---|---|---|---|---|
| 12757 | none | none | 52.7 | 83.1 |
| 12758 | L368D/K370S | S364K | 94.4 | 76.6 |
| 12759 | L368D/K370S | S364K/E357L | 90.2 | 77.2 |
| 12760 | L368D/K370S | S364K/E357Q | 95.2 | 77.5 |
| 12761 | T411E/K360E/Q362E | D401K | 85.6 | 80.6 |
| 12496 | L368E/K370S | S364K | 91.5 | n.d. |
| 12511 | K370S | S364K | 59.9 | n.d. |
| 12840 | L368E/K370S | S364K/E357Q | 59.5 | n.d. |
| 12841 | K370S | S364K/E357Q | 90.4 | n.d. |
| 12894 | L368E/K370S | S364K | 41.0 | n.d. |
| 12895 | K370S | S364K | 49.3 | n.d. |
| 12896 | L368E/K370S | S364K/E357Q | 73.9 | n.d. |
| 12901 | K370S | S364K/E357Q | 87.9 | n.d. |

Figure 15

| Anti-CD38 VH | Anti-CD38 VL | Anti-CD38 VH subs. | Anti-CD38 VL subs. | Bispecific XENP Paired with Anti-CD3 H1.30_L1.47 | Paired with Anti-CD3 HL79_L1.48 | K_D (CD38 binding) | Fold improved K_D (CD38 binding) | RTCC EC50 (RPMI8226) | Fold improved EC50 | Expression Yield (mg/L) | Half-life (d) |
|---|---|---|---|---|---|---|---|---|---|---|---|
| H1 | L1 | | L1 | 13243 | | 57 nM | -- | 20 pM | | 83.31 | 7.60 ± 0.87 |
| H1 | L1 | | L1 | | 13544 | 52 nM | -- | 60 pM | | 75.12 | 7.27 ± 0.84 |
| H1 | L1.24 | | N32W | 13545 | | 12 nM | 4.9 | 2 pM | 10.0 | 73.06 | 7.11 ± 0.47 |
| H1 | L1.96 | | T31Y N32W S50A Y53W S93V | 13546 | | 1.6 nM | 35 | 2 pM | 10.0 | 80.22 | 6.81 ± 0.62 |
| H1.77 | L1.96 | D28T R31Y D53Q | T31Y N32W S50A Y53W S93V | 13547 | | 0.7 nM | 84 | 1 pM | 20.0 | 67.89 | 6.89 ± 0.77 |
| H1.77 | L1.97 | D28T R31Y D53Q | T31Y N32W Y53W S93V | 13548 | | 1.0 nM | 57.6 | 0.9 pM | 22.2 | 52.35 | 7.13 ± 0.62 |
| H1.72 | L1.97 | R31Y D53Q | T31Y N32W Y53W S93V | 13549 | | 0.5 nM | 115 | 0.8 pM | 25.0 | 37.30 | 3.67 ± 0.34 |
| H1.71 | L1.96 | D28T D53Q | T31Y N32W S50A Y53W S93V | 13550 | | 1.2 nM | 45.7 | 0.8 pM | 25.0 | 55.29 | 7.90 ± 0.76 |
| H1.77 | L1.24 | D28T R31Y D53Q | N32W | 13551 | | 2.0 nM | 28.3 | 0.6 pM | 33.3 | 71.14 | 8.29 ± 0.77 |
| | | | | | 13694 | | | | | | |

Figure 20A

OKT10

VH (SEQ ID NO:463)

EVKLQESGGGLVQPGGSLKLSCAASGFDFSRSWMNWVRQAPGKGLEWIGEINPDSSTINYTTSLKDKFIISRDNAKNTL
YLQMTKVRSEDTALYYCARYGNWFPYWGQGTLVTVSA

VL (SEQ ID NO:464)

DIVMTQSPKIMPTSVGDRVSVTCKASQNVDTNVAWYQQKPGQSPKALIYSASYRYSGVPDRFTGSGSGTDFTLTITNV
QSEDLAEYFCQQYDSYPLTFGAGTKLDLK

XENP11855 (Anti-CD38_H1L1_IgG1)

Heavy chain (SEQ ID NO:465)

EVQLVESGGGLVQPGGSLRLSCAASGFDFSRSWMNWVRQAPGKGLEWVSEINPDSSTINYATSVKGRFTISRDNSKNT
LYLQMNSLRAEDTAVYYCARYGNWFPYWGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKTHTCPPCPAPELLGG
PSVFLFPPKPKDTLMISRTPEVTCVVVDVSHEDPEVKFNWYVDGVEVHNAKTKPREEQYNSTYRVVSVLTVLHQDWLN
GKEYKCKVSNKALPAPIEKTISKAKGQPREPQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSPGK

Light chain (SEQ ID NO:466)

DIVMTQSPSSLSASVGDRVTITCRASQNVDTNVAWYQQKPGQSPKALIYSASYRYSGVPDRFTGSGSGTDFTLTISSLQP
EDFATYFCQQYDSYPLTFGGGTKLEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 20B

XENP13243 (Anti-CD38_H1_L1 x Anti-CD3_H1.30_L1.47)

Heavy chain 1 (Anti-CD38 H1)    (SEQ ID NO:467)

EVQLVESGGGLVQPGGSLRLSCAASGFDFSRSWMNWVRQAPGKGLEWVSEINPDSSTINYATSVKGRFTISRDNSKNT
LYLQMNSLRAEDTAVYYCARYGNWFPYWGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Heavy chain 2 (Anti-CD3 H1.30 L1.47)    (SEQ ID NO:468)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

Light chain (Anti-CD38 L1)    (SEQ ID NO:469)

DIVMTQSPSSLSASVGDRVTITCRASQNVDTNVAWYQQKPGQSPKALIYSASYRYSGVPDRFTGSGSGTDFTLTISSLQP
EDFATYFCQQYDSYPLTFGGGTKLEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 20C

XENP13544 (Anti-CD38_H1_L1 x Anti-CD3_H1.79_L1.48)

Heavy chain 1 (Anti-CD38 H1)   (SEQ ID NO:470)

EVQLVESGGGLVQPGGSLRLSCAASGFDFSRSWMNWVRQAPGKGLEWVSEINPDSSTINYATSVKGRFTISRDNSKNT
LYLQMNSLRAEDTAVYYCARYGNWFPYWGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Heavy chain 2 (Anti-CD3 H1.79 L1.48)   (SEQ ID NO:471)

EVQLVESGGGLVQPGGSLRLSCAASGFTFSTYAMNWVRQAPGKCLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGCGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

Light chain (Anti-CD38 L1)   (SEQ ID NO:472)

DIVMTQSPSSLSASVGDRVTITCRASQNVDTNVAWYQQKPGQSPKALIYSASYRYSGVPDRFTGSGSGTDFTLTISSLQP
EDFATYFCQQYDSYPLTFGGGTKLEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 20D

XENP13545 (Anti-CD38_H1_L1.24 x Anti-CD3_H1.30_L1.47)

Heavy chain 1 (Anti-CD38 H1)   (SEQ ID NO:473)

EVQLVESGGGLVQPGGSLRLSCAASGFDFSRSWMNWVRQAPGKGLEWVSEINPDSSTINYATSVKGRFTISRDNSKNT
LYLQMNSLRAEDTAVYYCARYGNWFPYWGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Heavy chain 2 (Anti-CD3 H1.30 L1.47)   (SEQ ID NO:474)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

Light chain (Anti-CD38 L1.24)   (SEQ ID NO:475)

DIVMTQSPSSLSASVGDRVTITCRASQNVDTWVAWYQQKPGQSPKALIYSASYRYSGVPDRFTGSGSGTDFTLTISSLQ
PEDFATYFCQQYDSYPLTFGGGTKLEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 20E

XENP13546 (Anti-CD38_H1_L1.96 x Anti-CD3_H1.30_L1.47)

Heavy chain 1 (Anti-CD38 H1)   (SEQ ID NO:476)

EVQLVESGGGLVQPGGSLRLSCAASGFDFS<u>RSWMN</u>WVRQAPGKGLEWVS<u>EINPDSSTINYATSVKG</u>RFTISRDNSKNT
LYLQMNSLRAEDTAVYYCAR<u>YGNWFPY</u>WGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Heavy chain 2 (Anti-CD3 H1.30 L1.47)   (SEQ ID NO:477)

EVQLVESGGGLVQPGGSLRLSCAASGFTFS<u>TYAMN</u>WVRQAPGKGLEWVG<u>RIRSKYNNYATYYADSVKG</u>RFTISRDDSK
NTLYLQMNSLRAEDTAVYYCVRH<u>GNFGDSYVSWFAY</u>WGQGTLVTVSSGKPGSGKPGSGKPGSGKPGSQAVVTQEPS
LTVSPGGTVTLTC<u>GSSTGAVTTSNYAN</u>WVQQKPGKSPRGLIG<u>GTNKRAP</u>GVPARFSGSLLGGKAALTISGAQPEDEAD
YYC<u>ALWYSNHWV</u>FGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

Light chain (Anti-CD38 L1.96)   (SEQ ID NO:478)

DIVMTQSPSSLSASVGDRVTITC<u>RASQNVDYWVA</u>WYQQKPGQSPKALIY<u>AASWRYS</u>GVPDRFTGSGSGTDFTLTISSL
QPEDFATYFC<u>QQYDVYPLT</u>FGGGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

Figure 20F

XENP13547 (Anti-CD38_H1.77_L1.96 x Anti-CD3_H1.30_L1.47)

Heavy chain 1 (Anti-CD38 H1.77)  (SEQ ID NO:479)

EVQLVESGGGLVQPGGSLRLSCAASGFTFSYSWMNWVRQAPGKGLEWVSEINPQSSTINYATSVKGRFTISRDNSKNT
LYLQMNSLRAEDTAVYYCARYGNWFPYWGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Heavy chain 2 (Anti-CD3 H1.30 L1.47) (SEQ ID NO:480)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

Light chain (Anti-CD38 L1.96) (SEQ ID NO:481)

DIVMTQSPSSLSASVGDRVTITCRASQNVDYWVAWYQQKPGQSPKALIYAASWRYSGVPDRFTGSGSGTDFTLTISSL
QPEDFATYFCQQYDVYPLTFGGGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

Figure 20G

XENP13548 (Anti-CD38_H1.77_L1.97 x Anti-CD3_H1.30_L1.47)

Heavy chain 1 (Anti-CD38 H1.77)  (SEQ ID NO:482)

EVQLVESGGGLVQPGGSLRLSCAASGFTFSYSWMNWVRQAPGKGLEWVSEINPQSSTINYATSVKGRFTISRDNSKNT
LYLQMNSLRAEDTAVYYCARYGNWFPYWGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Heavy chain 2 (Anti-CD3 H1.30 L1.47)  (SEQ ID NO:483)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

Light chain (Anti-CD38 L1.97)  (SEQ ID NO:484)

DIVMTQSPSSLSASVGDRVTITCRASQNVDYWVAWYQQKPGQSPKALIYSASWRYSGVPDRFTGSGSGTDFTLTISSL
QPEDFATYFCQQYDVYPLTFGGGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

Figure 20H

XENP13549 (Anti-CD38_H1.72_L1.97 x Anti-CD3_H1.30_L1.47)

Heavy chain 1 (Anti-CD38 H1.72)   (SEQ ID NO:485)

EVQLVESGGGLVQPGGSLRLSCAASGFDFS<u>YSWMN</u>WVRQAPGKGLEWVS<u>EINPQSSTINYATSVKG</u>RFTISRDNSKNT
LYLQMNSLRAEDTAVYYCAR<u>YGNWFPY</u>WGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Heavy chain 2 (Anti-CD3 H1.30 L1.47)   (SEQ ID NO:486)

EVQLVESGGGLVQPGGSLRLSCAASGFTFS<u>TYAMN</u>WVRQAPGKGLEWVG<u>RIRSKYNNYATYYADSVKG</u>RFTISRDDSK
NTLYLQMNSLRAEDTAVYYCVR<u>HGNFGDSYVSWFAY</u>WGQGTLVTVSSGKPGSGKPGSGKPGSGKPGSQAVVTQEPS
LTVSPGGTVTLTC<u>GSSTGAVTTSNYAN</u>WVQQKPGKSPRGLIG<u>GTNKRAP</u>GVPARFSGSLLGGKAALTISGAQPEDEAD
YYC<u>ALWYSNHWV</u>FGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

Light chain (Anti-CD38 L1.97)   (SEQ ID NO:487)

DIVMTQSPSSLSASVGDRVTITC<u>RASQNVDYWVA</u>WYQQKPGQSPKALIY<u>SASWRYS</u>GVPDRFTGSGSGTDFTLTISSL
QPEDFATYFC<u>QQYDVYPLT</u>FGGGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

Figure 20I

XENP13550 (Anti-CD38_H1.71_L1.96 x Anti-CD3_H1.30_L1.47)

Heavy chain 1 (Anti-CD38 H1.71)    (SEQ ID NO:488)

EVQLVESGGGLVQPGGSLRLSCAASGFTFS<u>RSWMN</u>WVRQAPGKGLEWVS<u>EINPQSSTINYATSVKG</u>RFTISRDNSKNT
LYLQMNSLRAEDTAVYYCAR<u>YGNWFPY</u>WGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Heavy chain 2 (Anti-CD3 H1.30 L1.47)    (SEQ ID NO:489)

EVQLVESGGGLVQPGGSLRLSCAASGFTFS<u>TYAMN</u>WVRQAPGKGLEWVG<u>RIRSKYNNYATYYADSVKG</u>RFTISRDDSK
NTLYLQMNSLRAEDTAVYYCVR<u>HGNFGDSYVSWFAY</u>WGQGTLVTVSSGKPGSGKPGSGKPGSGKPGSQAVVTQEPS
LTVSPGGTVTLTC<u>GSSTGAVTTSNYAN</u>WVQQKPGKSPRGLIG<u>GTNKRAP</u>GVPARFSGSLLGGKAALTISGAQPEDEAD
YYC<u>ALWYSNHWV</u>FGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

Light chain (Anti-CD38 L1.96)    (SEQ ID NO:490)

DIVMTQSPSSLSASVGDRVTITC<u>RASQNVDYWVA</u>WYQQKPGQSPKALIY<u>AASWRYS</u>GVPDRFTGSGSGTDFTLTISSL
QPEDFATYFC<u>QQYDVYPLT</u>FGGGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

Figure 20J

XENP13551 (Anti-CD38_H1.77_L1.24 x Anti-CD3_H1.30_L1.47)

Heavy chain 1 (Anti-CD38 H1.77)  (SEQ ID NO:491)

EVQLVESGGGLVQPGGSLRLSCAASGFTFSYSWMNWVRQAPGKGLEWVSEINPQSSTINYATSVKGRFTISRDNSKNT
LYLQMNSLRAEDTAVYYCARYGNWFPYWGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Heavy chain 2 (Anti-CD3 H1.30 L1.47)  (SEQ ID NO:492)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

Light chain (Anti-CD38 L1.24)  (SEQ ID NO:493)

DIVMTQSPSSLSASVGDRVTITCRASQNVDTWVAWYQQKPGQSPKALIYSASYRYSGVPDRFTGSGSGTDFTLTISSLQ
PEDFATYFCQQYDSYPLTFGGGTKLEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 20K

XENP13694 (Anti-CD38_H1.77_L1.24 x Anti-CD3_H1.79_L1.48)

Heavy chain 1 (Anti-CD38 H1.77)  (SEQ ID NO:494)

EVQLVESGGGLVQPGGSLRLSCAASGFTFSYSWMNWVRQAPGKGLEWVSEINPQSSTINYATSVKGRFTISRDNSKNT
LYLQMNSLRAEDTAVYYCARYGNWFPYWGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Heavy chain 2 (Anti-CD3 H1.79 L1.48)  (SEQ ID NO:495)

EVQLVESGGGLVQPGGSLRLSCAASGFTFSTYAMNWVRQAPGKCLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGCGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

Light chain (Anti-CD38 L1.24)  (SEQ ID NO:496)

DIVMTQSPSSLSASVGDRVTITCRASQNVDTWVAWYQQKPGQSPKALIYSASYRYSGVPDRFTGSGSGTDFTLTISSLQ
PEDFATYFCQQYDSYPLTFGGGTKLEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 20L

XENP13752 (Anti-CD38_H1_L1.24 x Anti-CD3_H1.79_L1.48)

Heavy chain 1 (Anti-CD38 H1)    (SEQ ID NO:497)

EVQLVESGGGLVQPGGSLRLSCAASGFDFS<u>RSWMN</u>WVRQAPGKGLEWVS<u>EINPDSSTINYATSVK</u>GRFTISRDNSKNT
LYLQMNSLRAEDTAVYYCAR<u>YGNWFPY</u>WGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Heavy chain 2 (Anti-CD3 H1.79 L1.48)    (SEQ ID NO:498)

EVQLVESGGGLVQPGGSLRLSCAASGFTFS<u>TYAMN</u>WVRQAPGKCLEWVG<u>RIRSKYNNYATYYADSVK</u>GRFTISRDDSK
NTLYLQMNSLRAEDTAVYYCVR<u>HGNFGDSYVSWFAY</u>WGQGTLVTVSSGKPGSGKPGSGKPGSGKPGSQAVVTQEPS
LTVSPGGTVTLTC<u>GSSTGAVTTSNYAN</u>WVQQKPGKSPRGLIG<u>GTNKRAP</u>GVPARFSGSLLGGKAALTISGAQPEDEAD
YYC<u>ALWYSNHWV</u>FGCGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

Light chain (Anti-CD38 L1.24)    (SEQ ID NO:499)

DIVMTQSPSSLSASVGDRVTITC<u>RASQNVDTWVA</u>WYQQKPGQSPKALIY<u>SASYRYS</u>GVPDRFTGSGSGTDFTLTISSLQ
PEDFATYFC<u>QQYDSYPLT</u>FGGGTKLEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 20M

XENP13753 (Anti-CD38_H1_L1.96 x Anti-CD3_H1.79_L1.48)

Heavy chain 1 (Anti-CD38 H1) (SEQ ID NO:500)

EVQLVESGGGLVQPGGSLRLSCAASGFDFSRSWMNWVRQAPGKGLEWVSEINPDSSTINYATSVKGRFTISRDNSKNT
LYLQMNSLRAEDTAVYYCARYGNWFPYWGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Heavy chain 2 (Anti-CD3 H1.79 L1.48) (SEQ ID NO:501)

EVQLVESGGGLVQPGGSLRLSCAASGFTFSTYAMNWVRQAPGKCLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGCGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

Light chain (Anti-CD38 L1.96) (SEQ ID NO:502)

DIVMTQSPSSLSASVGDRVTITCRASQNVDYWVAWYQQKPGQSPKALIYAASWRYSGVPDRFTGSGSGTDFTLTISSL
QPEDFATYFCQQYDVYPLTFGGGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

Figure 20N

XENP13754 (Anti-CD38_H1.77_L1.96 x Anti-CD3_H1.79_L1.48)

Heavy chain 1 (Anti-CD38 H1.77) (SEQ ID NO:503)

EVQLVESGGGLVQPGGSLRLSCAASGFTFSYSWMNWVRQAPGKGLEWVSEINPQSSTINYATSVKGRFTISRDNSKNT
LYLQMNSLRAEDTAVYYCARYGNWFPYWGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Heavy chain 2 (Anti-CD3 H1.79 L1.48) (SEQ ID NO:504)

EVQLVESGGGLVQPGGSLRLSCAASGFTFSTYAMNWVRQAPGKCLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGCGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

Light chain (Anti-CD38 L1.96) (SEQ ID NO:505)

DIVMTQSPSSLSASVGDRVTITCRASQNVDYWVAWYQQKPGQSPKALIYAASWRYSGVPDRFTGSGSGTDFTLTISSL
QPEDFATYFCQQYDVYPLTFGGGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

Figure 20O

XENP13755 (Anti-CD38_H1.77_L1.97 x Anti-CD3_H1.79_L1.48)

Heavy chain 1 (Anti-CD38 H1.77) (SEQ ID NO:506)

EVQLVESGGGLVQPGGSLRLSCAASGFTFSYSWMNWVRQAPGKGLEWVSEINPQSSTINYATSVKGRFTISRDNSKNT
LYLQMNSLRAEDTAVYYCARYGNWFPYWGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Heavy chain 2 (Anti-CD3 H1.79 L1.48) (SEQ ID NO:507)

EVQLVESGGGLVQPGGSLRLSCAASGFTFSTYAMNWVRQAPGKCLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGCGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

Light chain (Anti-CD38 L1.97) (SEQ ID NO:508)

DIVMTQSPSSLSASVGDRVTITCRASQNVDYWVAWYQQKPGQSPKALIYSASWRYSGVPDRFTGSGSGTDFTLTISSL
QPEDFATYFCQQYDVYPLTFGGGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

Figure 20P

XENP13756 (Anti-CD38_H1.72_L1.97 x Anti-CD3_H1.79_L1.48)

Heavy chain 1 (Anti-CD38 H1.72)  (SEQ ID NO:509)

EVQLVESGGGLVQPGGSLRLSCAASGFDFSYSWMNWVRQAPGKGLEWVSEINPQSSTINYATSVKGRFTISRDNSKNT
LYLQMNSLRAEDTAVYYCARYGNWFPYWGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Heavy chain 2 (Anti-CD3 H1.79 L1.48)  (SEQ ID NO:510)

EVQLVESGGGLVQPGGSLRLSCAASGFTFSTYAMNWVRQAPGKCLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGCGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

Light chain (Anti-CD38 L1.97)  (SEQ ID NO:511)

DIVMTQSPSSLSASVGDRVTITCRASQNVDYWVAWYQQKPGQSPKALIYSASWRYSGVPDRFTGSGSGTDFTLTISSL
QPEDFATYFCQQYDVYPLTFGGGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

Figure 20Q

XENP13757 (Anti-CD38_H1.71_L1.96 x Anti-CD3_H1.79_L1.48)

Heavy chain 1 (Anti-CD38 H1.71)  (SEQ ID NO:512)

EVQLVESGGGLVQPGGSLRLSCAASGFTFSRSWMNWVRQAPGKGLEWVSEINPQSSTINYATSVKGRFTISRDNSKNT
LYLQMNSLRAEDTAVYYCARYGNWFPYWGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Heavy chain 2 (Anti-CD3 H1.79 L1.48)  (SEQ ID NO:513)

EVQLVESGGGLVQPGGSLRLSCAASGFTFSTYAMNWVRQAPGKCLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGCGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

Light chain (Anti-CD38 L1.96)  (SEQ ID NO:514)

DIVMTQSPSSLSASVGDRVTITCRASQNVDYWVAWYQQKPGQSPKALIYAASWRYSGVPDRFTGSGSGTDFTLTISSL
QPEDFATYFCQQYDVYPLTFGGGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

Figure 21

| scFv monomer (+) | Fab monomer (-) |
|---|---|
| Heterodimer pI variants S364K/E357Q | Heterodimerization pI variants L368D/K370S |
| scFv charged linker (GKPGS)4 | Isosteric pI substitutions N208D/Q295E/N384D/Q418E/N421D |
| FcKO E233P/L234V/L235A/G236del/S267K | FcKO E233P/L234V/L235A/G236del/S267K |
| ± 428L/434S for FcRn (optional) | ± 428L/434S for FcRn (optional) |
| CD3 scFv is H.1.30_L1.47 (no disulfide) or H1.79_L1.48 (with disulfide) ±charged linkers (optional) | Fv sequences for anti-CD38 as shown herein |

| scFv monomer | Fab monomer |
|---|---|
| Heterodimer pI variants S364K/E357Q | Heterodimerization pI variants L368D/K370S |
| scFv charged linker (GKPGS)4 | pI substitutions I199T N203D K274Q R355Q Q419E K447del |
| FcKO E233P/L234V/L235A/G236del/S267K | FcKO E233P/L234V/L235A/G236del/S267K |
| ± 428L/434S for FcRn (optional) | ± 428L/434S for FcRn (optional) |
| CD3 scFv is H.1.30_L1.47 (no disulfide) or H1.79_L1.48 (with disulfide) ±charged linkers (optional) | Fv sequences for anti-CD38 as shown herein |

Figure 22A

<u>XENP13243 HC-Fab</u>   (SEQ ID NO:515)

EVQLVESGGGLVQPGGSLRLSCAASGFDFS<u>RSWMN</u>WVRQAPGKGLEWVS<u>EINPDSSTINYATSVKG</u>RFTISRDNSKNT
LYLQMNSLRAEDTAVYYCAR<u>YGNWFPY</u>WGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

<u>XENP13243 HC-scFv</u>   (SEQ ID NO:516)

EVQLVESGGGLVQPGGSLRLSCAASGFTFS<u>TYAMN</u>WVRQAPGKGLEWVG<u>RIRSKYNNYATYYADSVKG</u>RFTISRDDSK
NTLYLQMNSLRAEDTAVYYCVR<u>HGNFGDSYVSWFAY</u>WGQGTLVTVSSGKPGSGKPGSGKPGSGKPGSQAVVTQEPS
LTVSPGGTVTLTC<u>GSSTGAVTTSNYAN</u>WVQQKPGKSPRGLIG<u>GTNKRAP</u>GVPARFSGSLLGGKAALTISGAQPEDEAD
YYC<u>ALWYSNHWV</u>FGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

<u>XENP13243 LC</u>   (SEQ ID NO:517)

DIVMTQSPSSLSASVGDRVTITC<u>RASQNVDTNVA</u>WYQQKPGQSPKALIY<u>SASYRYS</u>GVPDRFTGSGSGTDFTLTISSLQP
EDFATYFC<u>QQYDSYPLT</u>FGGGTKLEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC scFv of XENP13242 including charged linker   (SEQ ID NO:518)

EVQLVESGGGLVQPGGSLRLSCAASGFTFS<u>TYAMN</u>WVRQAPGKGLEWVG<u>RIRSKYNNYATYYADSVKG</u>RFTISRDDSK
NTLYLQMNSLRAEDTAVYYCVR<u>HGNFGDSYVSWFAY</u>WGQGTLVTVSSGKPGSGKPGSGKPGSGKPGSQAVVTQEPS
LTVSPGGTVTLTC<u>GSSTGAVTTSNYAN</u>WVQQKPGKSPRGLIG<u>GTNKRAP</u>GVPARFSGSLLGGKAALTISGAQPEDEAD
YYC<u>ALWYSNHWV</u>FGGGTKLTVL

Figure 22B

XENP13551 HC-Fab    (SEQ ID NO:519)

EVQLVESGGGLVQPGGSLRLSCAASGFTFS<u>YSWMN</u>WVRQAPGKGLEWVS<u>EINPQSSTINYATSVKG</u>RFTISRDNSKNT
LYLQMNSLRAEDTAVYYCAR<u>YGNWFPY</u>WGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

XENP13551 HC-scFv   (SEQ ID NO:520)

EVQLVESGGGLVQPGGSLRLSCAASGFTFS<u>TYAMN</u>WVRQAPGKGLEWVG<u>RIRSKYNNYATYYADSVKG</u>RFTISRDDSK
NTLYLQMNSLRAEDTAVYYCVR<u>HGNFGDSYVSWFAY</u>WGQGTLVTVSSGKPGSGKPGSGKPGSGKPGSQAVVTQEPS
LTVSPGGTVTLTC<u>GSSTGAVTTSNYAN</u>WVQQKPGKSPRGLIGG<u>TNKRAP</u>GVPARFSGSLLGGKAALTISGAQPEDEAD
YYC<u>ALWYSNHWV</u>FGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

XENP13551 LC   (SEQ ID NO:521)

DIVMTQSPSSLSASVGDRVTITC<u>RASQNVDTWVA</u>WYQQKPGQSPKALIY<u>SASYRYS</u>GVPDRFTGSGSGTDFTLTISSLQ
PEDFATYFC<u>QQYDSYPLT</u>FGGGTKLEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC scFv of XENP13551 including charged linker (SEQ ID NO:522)

EVQLVESGGGLVQPGGSLRLSCAASGFTFS<u>TYAMN</u>WVRQAPGKGLEWVG<u>RIRSKYNNYATYYADSVKG</u>RFTISRDDSK
NTLYLQMNSLRAEDTAVYYCVR<u>HGNFGDSYVSWFAY</u>WGQGTLVTVSSGKPGSGKPGSGKPGSGKPGSQAVVTQEPS
LTVSPGGTVTLTC<u>GSSTGAVTTSNYAN</u>WVQQKPGKSPRGLIGG<u>TNKRAP</u>GVPARFSGSLLGGKAALTISGAQPEDEAD
YYC<u>ALWYSNHWV</u>FGGGTKLTVL

Figure 23A

XENP13243 HC-Fab (XenD08502) (SEQ ID NO:523)

GAAGTCCAGCTCGTGGAGTCGGGTGGCGGCCTCGTCCAGCCCGGCGGCTCGCTCCGGCTGTCATGCGCCGCGAG
CGGGTTCGATTTCAGTCGTTCGTGGATGAACTGGGTACGCCAGGCCCCGGGCAAGGGCCTCGAATGGGTCTCCGA
GATCAACCCGGACAGCAGCACGATCAACTACGCCACCTCGGTGAAGGGCCGGTTCACGATCAGCCGCGACAACTC
CAAGAACACCCTCTACCTGCAGATGAACTCCCTGCGCGCCGAGGACACGGCCGTCTACTACTGCGCGCGCTACGG
AAACTGGTTCCCGTACTGGGGCCAGGGCACACTGGTCACTGTCTCCAGCGCGTCCACGAAGGGCCCGTCGGTCTT
CCCCCTGGCGCCAAGCTCGAAAAGTACGTCCGGCGGGACCGCAGCGCTGGGCTGCCTGGTCAAGGACTACTTCCC
CGAGCCCGTGACCGTGAGCTGGAACTCGGGCGCGCTGACCTCCGGCGTCCACACCTTCCCGGCAGTCCTCCAGTC
GTCGGGCCTGTACTCGCTGTCCAGCGTCGTCACGGTGCCGTCGTCCTCCCTGGGCACGCAGACGTACATCTGCAAC
GTGAACCACAAGCCGAGCGACACCAAGGTCGACAAGAAGGTCGAGCCCAAGTCGTGCGACAAGACCCACACGTG
CCCGCCGTGCCCGGCCCCCCTGTCGCCGGCCCCAGTGTCTTCCTCTTCCCGCCGAAGCCGAAGGACACCCTCATG
ATCTCGCGCACCCCCGAGGTCACCTGCGTGGTCGTGGACGTGAAGCACGAGGACCCTGAGGTTAAGTTCAACTGG
TATGTCGACGGGGTGGAGGTCCACAACGCGAAGACCAAGCCGCGCGAGGAGGAGTACAACAGTACGTACCGCGT
GGTCTCGGTGCTCACCGTCCTCCACCAGGACTGGCTGAACGGCAAGGAATACAAGTGTAAGGTCAGCAACAAGGC
CTTGCCCGCCCCCATCGAGAAGACCATAAGCAAGGCCAAGGGTCAGCCAAGGGAACCGCAGGTGTACACCCTCCC
GCCCTCCCGCGAGGAGATGACCAAGAACCAGGTATCACTGACCTGCGACGTGTCCGGGTTCTACCCGTCCGACAT
CGCGGTGGAGTGGGAGTCCGACGGCCAGCCGGAGAACAACTACAAGACCACCCCCCCGGTACTCGACTCCGACG
GTTCGTTCTTCCTCTACTCCAAGCTGACGGTGGACAAGTCCCGGTGGGAGCAAGGCGACGTGTTCAGCTGTTCCGT
CATGCACGAGGCCCTGCACAACCACTACACCCAGAAGAGTCTGTCCCTCTCCCCTGGCAAATGA

Figure 23B

XENP13243 HC-scFv (XenD08438)   (SEQ ID NO:524)

GAAGTCCAGCTCGTGGAGTCGGGCGGCGGCCTCGTGCAACCGGGTGGCTCGCTGCGGCTCTCCTGCGCCGCGTCC
GGCTTCACGTTCTCCACCTACGCCATGAACTGGGTCCGCCAGGCGCCGGGCAAGGGGCTCGAGTGGGTGGGGCG
TATCCGCTCCAAGTACAACAACTACGCGACGTACTACGCCGATAGCGTAAAGGGACGCTTCACAATCTCGCGGGA
CGACAGCAAGAACACCCTTTACCTCCAGATGAACAGCCTGCGCGCCGAAGACACCGCCGTGTACTACTGTGTCCG
GCACGGGAACTTCGGCGACTCCTACGTCTCGTGGTTCGCCTACTGGGGCCAGGGCACCCTCGTCACCGTGTCCTCG
GGAAAGCCGGGGAGCGGAAAGCCGGGTTCGGGCAAGCCAGGCTCCGGTAAGCCGGGCTCGCAGGCGGTGGTG
ACCCAGGAGCCATCCCTGACCGTGTCCCCGGGGGGCACCGTCACGCTGACTTGCGGCTCCTCGACCGGTGCCGTC
ACCACCTCCAACTACGCCAACTGGGTGCAGCAGAAGCCCGGCAAGAGCCCCCGCGGCCTGATCGGCGGCACGAA
CAAGCGCGCGCCCGGCGTCCCGGCCCGCTTCTCCGGCTCCCTGCTGGGCGGGAAGGCCGCGCTCACCATCAGCGG
CGCGCAGCCCGAGGACGAGGCCGACTACTACTGCGCGCTCTGGTACTCGAACCACTGGGTCTTCGGCGGCGGGA
CCAAGCTCACCGTGCTCGAGCCGAAGTCCTCGGACAAGACCCACACATGCCCCCCCTGCCCGGCCCCCCCGTGGC
GGGCCCCTCTGTCTTCCTGTTTCCCCCGAAGCCGAAGGACACCCTGATGATCTCGCGCACGCCGGAAGTGACCTGC
GTCGTCGTCGACGTGAAGCACGAGGACCCAGAGGTCAAGTTCAACTGGTACGTCGACGGCGTCGAGGTGCACAA
CGCGAAGACGAAGCCCCGTGAGGAGCAGTACAACTCCACCTACCGGGTGGTGTCGGTGCTGACGGTGCTCCACC
AGGACTGGCTGAACGGCAAGGAGTACAAGTGTAAGGTCTCCAACAAGGCCCTCCCGGCCCCCATCGAGAAGACC
ATCTCGAAGGCCAAGGGCCAGCCGCGCGAGCCGCAGGTGTACACGCTCCCGCCCTCGCGGGAGCAGATGACCAA
GAACCAGGTGAAGCTGACCTGCCTCGTGAAGGGCTTCTACCCGAGCGACATCGCGGTGGAGTGGGAGTCCAACG
GCCAACCGGAGAACAACTACAAGACCACTCCGCCGGTGCTGGACTCGGATGGGTCGTTCTTCCTCTACTCGAAGCT
CACGGTAGACAAGTCCCGCTGGCAGCAGGGCAACGTCTTCTCCTGCTCCGTCATGCACGAGGCCCTCCACAACCAC
TATACCCAGAAGTCGCTCTCGCTCTCCCCGGGAAAGTGA

Figure 23C

XENP13243 LC (XenD07263) (SEQ ID NO:525)

GACATCGTCATGACGCAGTCGCCGAGCAGCCTCTCCGCATCGGTGGGTGACCGCGTCACCATCACCTGCCGGGCG
AGCCAGAACGTCGACACCAACGTGGCCTGGTATCAGCAGAAGCCGGGCCAGAGTCCGAAGGCCCTGATCTACAG
CGCCTCGTACCGCTACTCGGGCGTGCCCGACCGGTTCACGGGCAGCGGCTCGGGGACGGACTTCACGCTGACCAT
CTCCTCGCTGCAGCCGGAGGACTTCGCCACCTACTTCTGCCAGCAGTACGACTCCTATCCCCTGACGTTCGGGGGA
GGGACCAAGCTCGAGATCAAGCGCACCGTCGCCGCCCCTCCGTGTTCATCTTCCCGCCGAGCGACGAGCAGCTG
AAGAGCGGGACCGCCAGCGTGGTGTGCCTCCTCAACAACTTCTACCCGCGCGAGGCCAAGGTGCAGTGGAAGGT
GGACAACGCGCTGCAGAGCGGCAACTCCCAAGAGTCCGTGACCGAGCAGGACAGCAAGGATTCCACCTATTCGCT
GTCCTCCACCCTGACCCTCTCGAAGGCCGACTACGAGAAGCACAAGGTGTACGCCTGCGAGGTCACGCACCAGGG
TCTCAGCAGCCCCGTCACCAAGTCCTTCAATCGGGGCGAGTGCTGA

XENP13551 HC-Fab (XenD08503) (SEQ ID NO:526)

GAAGTCCAGCTCGTGGAGTCGGGTGGCGGCCTCGTCCAGCCCGGCGGCTCGCTCCGGCTGTCATGCGCCGCGAG
CGGGTTCACTTTCAGTTACTCGTGGATGAACTGGGTACGCCAGGCCCCGGGCAAGGGCCTCGAATGGGTCTCCGA
GATCAACCCGCAGAGCAGCACGATCAACTACGCCACCTCGGTGAAGGGCCGGTTCACGATCAGCCGCGACAACTC
CAAGAACACCCTCTACCTGCAGATGAACTCCCTGCGCGCCGAGGACACGGCCGTCTACTACTGCGCGCGCTACGG
AAACTGGTTCCCGTACTGGGGCCAGGGCACACTGGTCACTGTCTCCAGCGCGTCCACGAAGGGCCCGTCGGTCTT
CCCCCTGGCGCCAAGCTCGAAAAGTACGTCCGGCGGGACCGCAGCGCTGGGCTGCCTGGTCAAGGACTACTTCCC
CGAGCCCGTGACCGTGAGCTGGAACTCGGGCGCGCTGACCTCCGGCGTCCACACCTTCCCGGCAGTCCTCCAGTC
GTCGGGCCTGTACTCGCTGTCCAGCGTCGTCACGGTGCCGTCGTCCTCCCTGGGCACGCAGACGTACATCTGCAAC
GTGAACCACAAGCCGAGCGACACCAAGGTCGACAAGAAGGTCGAGCCCAAGTCGTGCGACAAGACCCACACGTG
CCCGCCGTGCCCGGCCCCCCTGTCGCCGGCCCCAGTGTCTTCCTCTTCCCGCCGAAGCCGAAGGACACCCTCATG
ATCTCGCGCACCCCCGAGGTCACCTGCGTGGTCGTGGACGTGAAGCACGAGGACCCTGAGGTTAAGTTCAACTGG
TATGTCGACGGGGTGGAGGTCCACAACGCGAAGACCAAGCCGCGCGAGGAGGAGTACAACAGTACGTACCGCGT
GGTCTCGGTGCTCACCGTCCTCCACCAGGACTGGCTGAACGGCAAGGAATACAAGTGTAAGGTCAGCAACAAGGC
CTTGCCCGCCCCCATCGAGAAGACCATAAGCAAGGCCAAGGGTCAGCCAAGGGAACCGCAGGTGTACACCCTCCC
GCCCTCCCGCGAGGAGATGACCAAGAACCAGGTATCACTGACCTGCGACGTGTCCGGGTTCTACCCGTCCGACAT
CGCGGTGGAGTGGGAGTCCGACGGCCAGCCGGAGAACAACTACAAGACCACCCCCCCGGTACTCGACTCCGACG
GTTCGTTCTTCCTCTACTCCAAGCTGACGGTGGACAAGTCCCGGTGGGAGCAAGGCGACGTGTTCAGCTGTTCCGT
CATGCACGAGGCCCTGCACAACCACTACACCCAGAAGAGTCTGTCCCTCTCCCCTGGCAAATGA

Figure 23D

XENP13551 HC-scFv (XenD08438) (SEQ ID NO:527)

GAAGTCCAGCTCGTGGAGTCGGGCGGCGGCCTCGTGCAACCGGGTGGCTCGCTGCGGCTCTCCTGCGCCGCGTCC
GGCTTCACGTTCTCCACCTACGCCATGAACTGGGTCCGCCAGGCGCCGGGCAAGGGGCTCGAGTGGGTGGGGCG
TATCCGCTCCAAGTACAACAACTACGCGACGTACTACGCCGATAGCGTAAAGGGACGCTTCACAATCTCGCGGGA
CGACAGCAAGAACACCCTTTACCTCCAGATGAACAGCCTGCGCGCCGAAGACACCGCCGTGTACTACTGTGTCCG
GCACGGGAACTTCGGCGACTCCTACGTCTCGTGGTTCGCCTACTGGGGCCAGGGCACCCTCGTCACCGTGTCCTCG
GGAAAGCCGGGGAGCGGAAAGCCGGGTTCGGGCAAGCCAGGCTCCGGTAAGCCGGGCTCGCAGGCGGTGGTG
ACCCAGGAGCCATCCCTGACCGTGTCCCCGGGGGGCACCGTCACGCTGACTTGCGGCTCCTCGACCGGTGCCGTC
ACCACCTCCAACTACGCCAACTGGGTGCAGCAGAAGCCCGGCAAGAGCCCCGCGGCCTGATCGGCGGCACGAA
CAAGCGCGCGCCCGGCGTCCCGGCCCGCTTCTCCGGCTCCCTGCTGGGCGGGAAGGCCGCGCTCACCATCAGCGG
CGCGCAGCCCGAGGACGAGGCCGACTACTACTGCGCGCTCTGGTACTCGAACCACTGGGTCTTCGGCGGCGGGA
CCAAGCTCACCGTGCTCGAGCCGAAGTCCTCGGACAAGACCCACACATGCCCCCCCTGCCCGGCCCCCCCGTGGC
GGGCCCCTCTGTCTTCCTGTTTCCCCCGAAGCCGAAGGACACCCTGATGATCTCGCGCACGCCGGAAGTGACCTGC
GTCGTCGTCGACGTGAAGCACGAGGACCCAGAGGTCAAGTTCAACTGGTACGTCGACGGCGTCGAGGTGCACAA
CGCGAAGACGAAGCCCCGTGAGGAGCAGTACAACTCCACCTACCGGGTGGTGTCGGTGCTGACGGTGCTCCACC
AGGACTGGCTGAACGGCAAGGAGTACAAGTGTAAGGTCTCCAACAAGGCCCTCCCGGCCCCCATCGAGAAGACC
ATCTCGAAGGCCAAGGGCCAGCCGCGCGAGCCGCAGGTGTACACGCTCCCGCCCTCGCGGGAGCAGATGACCAA
GAACCAGGTGAAGCTGACCTGCCTCGTGAAGGGCTTCTACCCGAGCGACATCGCGGTGGAGTGGGAGTCCAACG
GCCAACCGGAGAACAACTACAAGACCACTCCGCCGGTGCTGGACTCGGATGGGTCGTTCTTCCTCTACTCGAAGCT
CACGGTAGACAAGTCCCGCTGGCAGCAGGGCAACGTCTTCTCCTGCTCCGTCATGCACGAGGCCCTCCACAACCAC
TATACCCAGAAGTCGCTCTCGCTCTCCCCGGGAAAGTGA

XENP13551 LC (XenD07821) (SEQ ID NO:528)

GACATCGTCATGACGCAGTCGCCGAGCAGCCTCTCCGCATCGGTGGGTGACCGCGTCACCATCACCTGCCGGGCG
AGCCAGAACGTCGACACCTGGGTGGCCTGGTATCAGCAGAAGCCGGGCCAGAGTCCGAAGGCCCTGATCTACAG
CGCCTCGTACCGCTACTCGGGCGTGCCCGACCGGTTCACGGGCAGCGGCTCGGGGACGGACTTCACGCTGACCAT
CTCCTCGCTGCAGCCGGAGGACTTCGCCACCTACTTCTGCCAGCAGTACGACTCCTATCCCCTGACGTTCGGGGGA
GGGACCAAGCTCGAGATCAAGCGCACCGTCGCCGCCCCTCCGTGTTCATCTTCCCGCCGAGCGACGAGCAGCTG
AAGAGCGGGACCGCCAGCGTGGTGTGCCTCCTCAACAACTTCTACCCGCGCGAGGCCAAGGTGCAGTGGAAGGT
GGACAACGCGCTGCAGAGCGGCAACTCCCAAGAGTCCGTGACCGAGCAGGACAGCAAGGATTCCACCTATTCGCT
GTCCTCCACCCTGACCCTCTCGAAGGCCGACTACGAGAAGCACAAGGTGTACGCCTGCGAGGTCACGCACCAGGG
TCTCAGCAGCCCCGTCACCAAGTCCTTCAATCGGGGCGAGTGCTGA

Figure 24

| XENP | Pool ID# | HC-Fab | HC-scFv | LC | HC-Fab : HC-scFv : LC Ratio |
|---|---|---|---|---|---|
| 13243 | 43A | 1 | 0.667 | 1.5 | 1 : 0.667 : 1.5 |
|  | 43B | 1 | 1 | 1.5 | 1 : 1 : 1.5 |
|  | 43C | 1 | 1.5 | 1.5 | 1 : 1.5 : 1.5 |
|  | 43D | 1 | 2 | 1.5 | 1 : 2 : 1.5 |
|  | 43E | 1 | 0.667 | 2 | 1 : 0.667 : 2 |
|  | 43F | 1 | 1 | 2 | 1 : 1 : 2 |
|  | 43G | 1 | 1.5 | 2 | 1 : 1.5 : 2 |
|  | 43H | 1 | 2 | 2 | 1 : 2 : 2 |

| XENP | Pool ID# | HC-Fab | HC-scFv | LC | HC-Fab : HC-scFv : LC Ratio |
|---|---|---|---|---|---|
| 13551 | 51A | 1 | 0.667 | 1.5 | 1 : 0.667 : 1.5 |
|  | 51B | 1 | 1 | 1.5 | 1 : 1 : 1.5 |
|  | 51C | 1 | 1.5 | 1.5 | 1 : 1.5 : 1.5 |
|  | 51D | 1 | 2 | 1.5 | 1 : 2 : 1.5 |
|  | 51E | 1 | 0.667 | 2 | 1 : 0.667 : 2 |
|  | 51F | 1 | 1 | 2 | 1 : 1 : 2 |
|  | 51G | 1 | 1.5 | 2 | 1 : 1.5 : 2 |
|  | 51H | 1 | 2 | 2 | 1 : 2 : 2 |

Figure 26

| XENP | Pool ID# | HC-Fab : HC-scFv : LC Ratio | % HC-Fab Homodimer plus Monomer | % Heterodimer | % HC-scFv Homodimer plus Monomer |
|---|---|---|---|---|---|
| 13243 | 43A | 1 : 0.667 : 1.5 | 34.93 | 65.07 | - |
|  | 43B | 1 : 1 : 1.5 | 38.91 | 61.09 | - |
|  | 43C | 1 : 1.5 : 1.5 | 1.64 | 93.61 | 4.75 |
|  | 43D | 1 : 2 : 1.5 | 2.40 | 94.83 | 2.77 |
|  | 43E | 1 : 0.667 : 2 | 14.44 | 85.56 | - |
|  | 43F | 1 . 1 : 2 | 2.78 | 93.32 | 3.90 |
|  | 43G | 1 . 1.5 : 2 | 13.13 | 86.67 |  |
|  | 43H | 1 : 2 : 2 | 1.27 | 95.00 | 3.06 |

| XENP | Pool ID# | HC-Fab : HC-scFv : LC Ratio | % HC-Fab Homodimer plus Monomer | % Heterodimer | % HC-scFv Homodimer plus Monomer |
|---|---|---|---|---|---|
| 13551 | 51A | 1 : 0.667 : 1.5 | 43.36 | 56.64 | - |
|  | 51B | 1 : 1 : 1.5 | 19.36 | 76.72 | 3.92 |
|  | 51C | 1 : 1.5 : 1.5 | 7.19 | 87.32 | 5.49 |
|  | 51D | 1 : 2 : 1.5 | 7.26 | 75.40 | 17.33 |
|  | 51E | 1 : 0.667 : 2 | 32.63 | 59.88 | 7.49 |
|  | 51F | 1 : 1 : 2 | 8.54 | 91.46 | - |
|  | 51G | 1 : 1.5 : 2 | 5.53 | 88.24 | 6.23 |
|  | 51H | 1 : 2 : 2 | 2.53 | 91.06 | 6.41 |

Figure 29

| Variant | Antigen | ka (1/M*s) | kd (1/s) | KA (1/M) | KD (M) | Format |
|---|---|---|---|---|---|---|
| XENP13243 | human CD38 | 1.57E+05 | 8.88E-03 | 1.77E+07 | 5.66E-08 | Protein A capture[1] |
| XENP13243 | human CD38 | 5.41E+05 | 9.07E-03 | 5.97E+07 | 1.68E-08 | Antigen directly coupled[2] |
| XENP13243 | human CD3 | 6.25E+05 | 5.07E-03 | 1.23E+08 | 8.10E-09 | Protein A capture[1] |
| XENP13243 | cyno CD38 | 6.23E+05 | 1.01E-02 | 6.17E+07 | 1.62E-08 | Antigen directly coupled[2] |
| XENP13243 | cyno CD3 | 7.58E+05 | 4.29E-03 | 1.77E+08 | 5.65E-09 | Protein A capture[1] |
| XENP13551 | human CD38 | 1.03E+05 | 2.06E-04 | 5.00E+08 | 2.00E-09 | Protein A capture[1] |
| XENP13551 | human CD38 | 1.01E+06 | 1.98E-04 | 5.12E+09 | 1.95E-10 | Antigen directly coupled[2] |
| XENP13551 | cyno CD38 | 1.50E+06 | 4.17E-04 | 3.61E+09 | 2.77E-10 | Antigen directly coupled[2] |

[1]Protein A capture: Bispecific protein is captured by a protein A chip, followed by soluble antigen.

[2]Antigen directly coupled: Antigen is covalently coupled to the chip surface, bispecific protein follows.

Figure 32

| Variant constant region | Substitutions |
|---|---|
| pI_ISO(-) | I199T N203D K274Q R355Q N384S K392N V397M Q419E DEL447 |
| pI_(-)_isosteric_A | N208D Q295E N384D Q418E N421D |
| pI_(-)_isosteric_B | N208D Q295E Q418E N421D |
| pI_ISO(+RR) | Q196K I199T P217R P228R N276K |
| pI_ISO(+) | Q196K I199T N276K |
| pI_(+)_isosteric_A | E269Q E272Q E283Q E357Q |
| pI_(+)_isosteric_B | E269Q E272Q E283Q |
| pI_(+)_isosteric_E269Q/E272Q | E269Q E272Q |
| pI_(+)_isosteric_E269Q/E283Q | E269Q E283Q |
| pI_(+)_isosteric_E272Q/E283Q | E272Q E283Q |
| pI_(+)_isosteric_E269Q | E269Q |

Figure 33

| XENP | Variant | Linker Sequence | SEQ ID NO | Length | Charge | Tm1 (°C) |
|---|---|---|---|---|---|---|
| 12241 | CD3_H1.30_L1.47_scFv_His | GGGGSGGGGSGGGGS | 441 | 15 | 0 | 68.0 |
| 12782 | CD3_H1.30_L1.47_scFv_His_scFvLinker(+A) | IRPRAIGGSKPRVA | 443 | 14 | +4 | 66.0 |
| 12783 | CD3_H1.30_L1.47_scFv_His_scFvLinker(+B) | GKGGSGKGGSGKGGS | 444 | 15 | +3 | 68.0 |
| 12784 | CD3_H1.30_L1.47_scFv_His_scFvLinker(+C) | GGKGSGGKGSGGKGS | 445 | 15 | +3 | 68.0 |
| 12785 | CD3_H1.30_L1.47_scFv_His_scFvLinker(+D) | GGGKSGGGKSGGGKS | 446 | 15 | +3 | 68.5 |
| 12786 | CD3_H1.30_L1.47_scFv_His_scFvLinker(+E) | GKGKSGKGKSGKGKS | 447 | 15 | +6 | 68.5 |
| 12787 | CD3_H1.30_L1.47_scFv_His_scFvLinker(+F) | GGGKSGGKGSGKGGS | 448 | 15 | +3 | 68.0 |
| 12788 | CD3_H1.30_L1.47_scFv_His_scFvLinker(+G) | GKPGSGKPGSGKPGS | 449 | 15 | +3 | 68.0 |
| 12789 | CD3_H1.30_L1.47_scFv_His_scFvLinker(+H) | GKPGSGKPGSGKPGSGKPGS | 450 | 20 | +4 | 69.0 |
| 12790 | CD3_H1.30_L1.47_scFv_His_scFvLinker(+I) | GKGKSGKGKSGKGKSGKGKS | 451 | 20 | +8 | 69.5 |

Figure 34
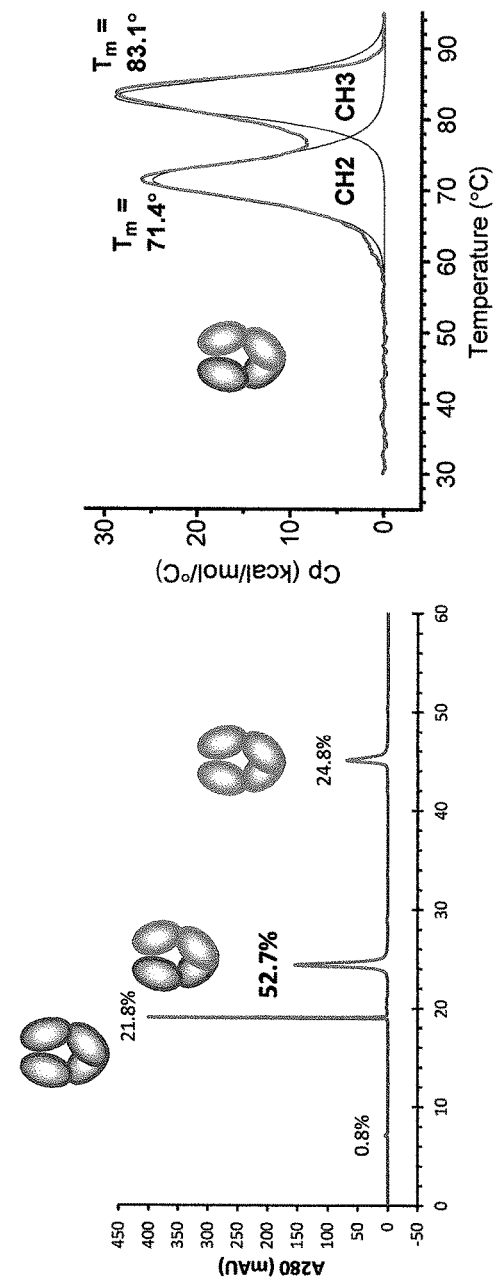
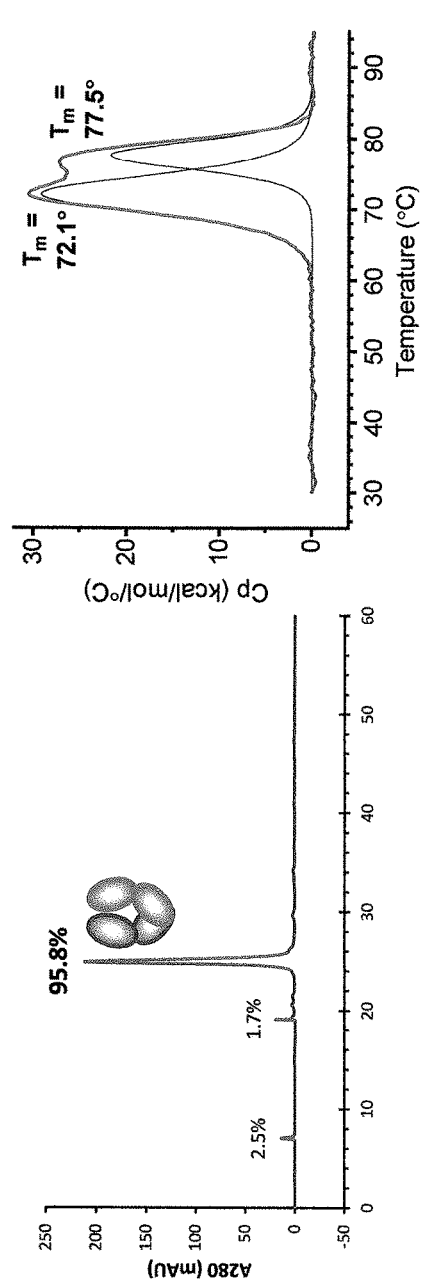
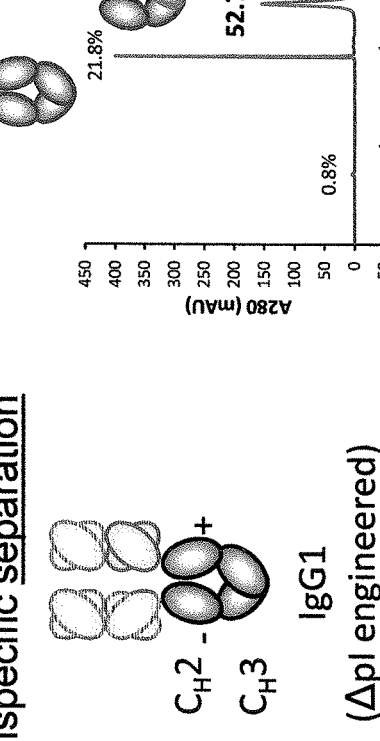
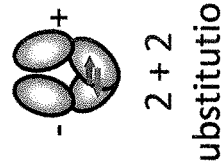

Figure 36
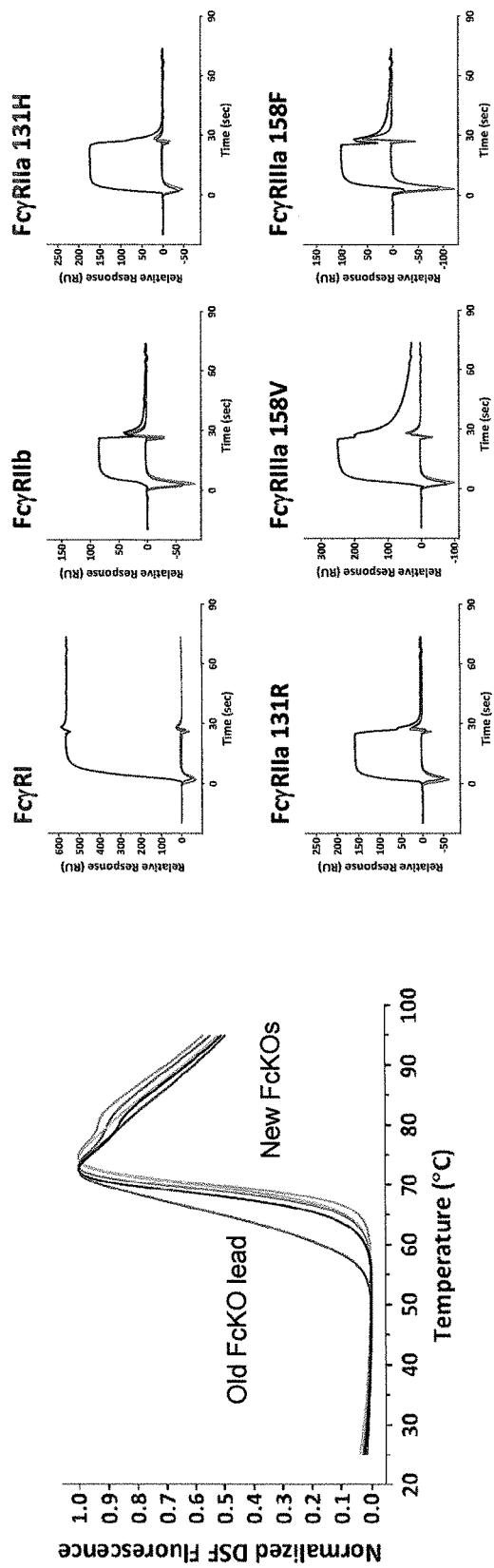
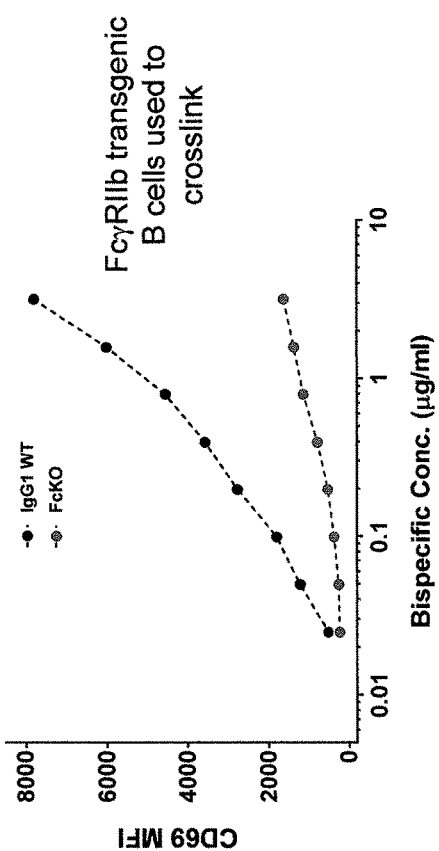
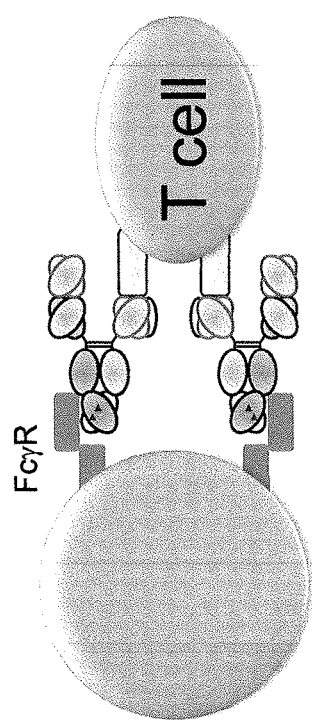

Figure 41
Redistribution from blood
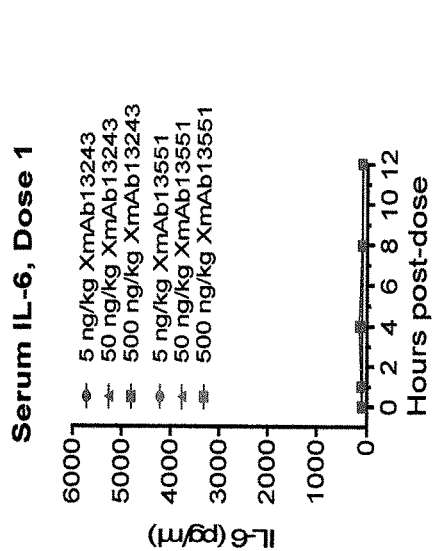
CD69 induction
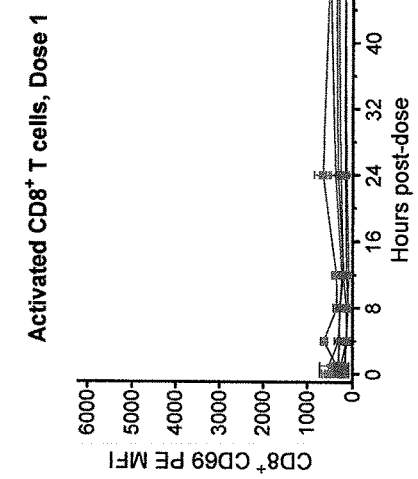
Cytokine release
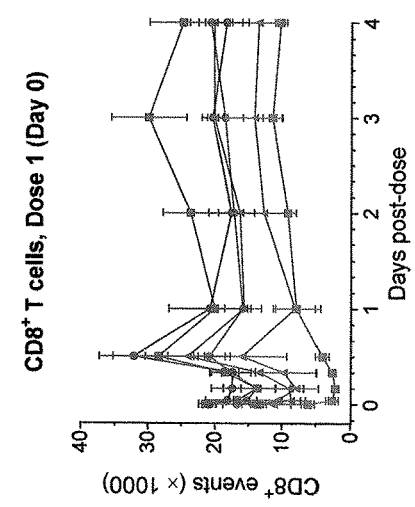
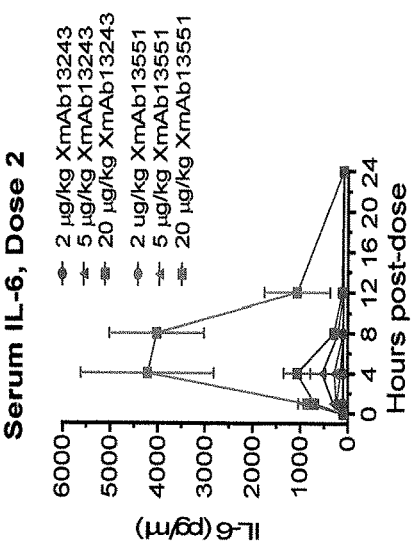
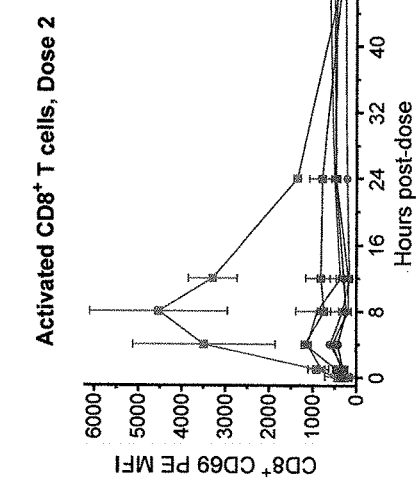
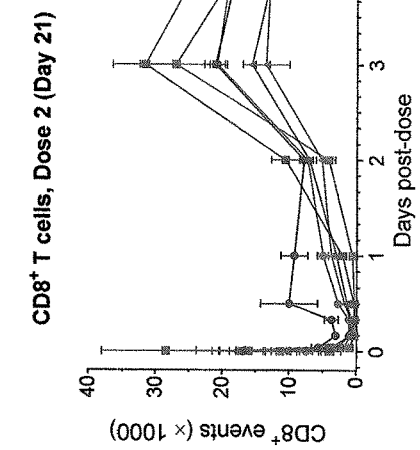

Stable Cell Clones (Stage 1) – Top Individual clones from Pool C

Analytical IEX profiles of protein A purified product (↓ - Heterodimer)

Clones 02, 12, 14 and 23 are in final stages (SCC2) of cell line development

Figure 43

3L Bioreactor Optimization (3 conditions)
BalanCD medium with ActiCHO Feed A & B (varying schedule and percentage), Glucose supplementation, pH set point, Temp shift

Yield & Product Profile (Heterodimer content)

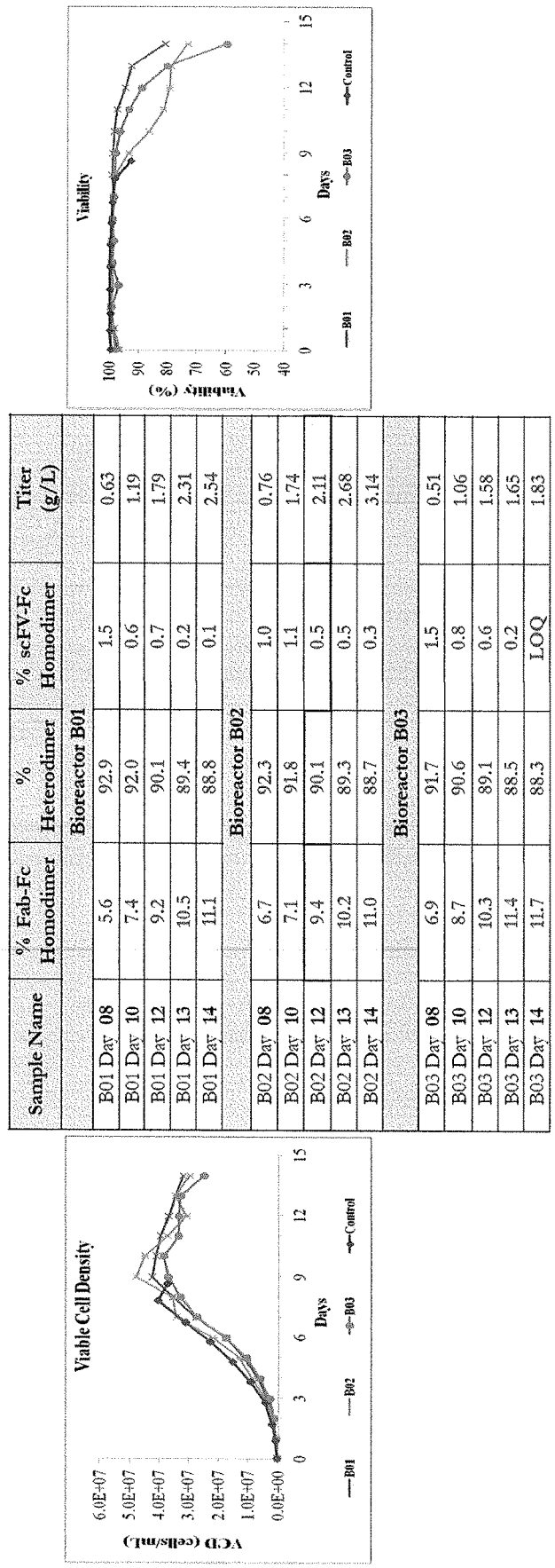

| Sample Name | % Fab-Fc Homodimer | % Heterodimer | % scFV-Fc Homodimer | Titer (g/L) |
|---|---|---|---|---|
| Bioreactor B01 | | | | |
| B01 Day 08 | 5.6 | 92.9 | 1.5 | 0.63 |
| B01 Day 10 | 7.4 | 92.0 | 0.6 | 1.19 |
| B01 Day 12 | 9.2 | 90.1 | 0.7 | 1.79 |
| B01 Day 13 | 10.5 | 89.4 | 0.2 | 2.31 |
| B01 Day 14 | 11.1 | 88.8 | 0.1 | 2.54 |
| Bioreactor B02 | | | | |
| B02 Day 08 | 6.7 | 92.3 | 1.0 | 0.76 |
| B02 Day 10 | 7.1 | 91.8 | 1.1 | 1.74 |
| B02 Day 12 | 9.4 | 90.1 | 0.5 | 2.11 |
| B02 Day 13 | 10.2 | 89.3 | 0.5 | 2.68 |
| B02 Day 14 | 11.0 | 88.7 | 0.3 | 3.14 |
| Bioreactor B03 | | | | |
| B03 Day 08 | 6.9 | 91.7 | 1.5 | 0.51 |
| B03 Day 10 | 8.7 | 90.6 | 0.8 | 1.06 |
| B03 Day 12 | 10.3 | 89.1 | 0.6 | 1.58 |
| B03 Day 13 | 11.4 | 88.5 | 0.2 | 1.65 |
| B03 Day 14 | 11.7 | 88.3 | LOQ | 1.83 |

Figure 44

| Material Supply Run | Product-related Tests | | | Impurity Tests | |
|---|---|---|---|---|---|
| ID | Product Yield (%) | Protein Conc. (g/L) | HMW/Main/LMW (%) | HCP (ppm) | Fab-Fc Homodimer /Heterodimer/scFv-Fc Homodimer (%) |
| Assay Method | A280 | A280/Protein A Titer | SEC-HPLC | ELISA | CEX-HPLC |
| Clarified Harvest | n/a | 0.95 | n/a | n/a | n/a |
| MabSelect SuRe Eluate | 92 | 13.8 | 7.3/92.2/0.5 | 307 | 9.6/90.2/0.3 |
| Capto S ImpAct Load | 93 | 6.08 | 7.2/92.2/0.6 | <83 | 9.5/90.0/0.6 |
| Capto S ImpAct Eluate | 76 | 12.4 | 2.6/97.4/0.0 | 21 | ND/100/ND |
| Capto adhere Load | n/a | 3.04 | 3.3/96.7/0.0 | 23 | ND/100/ND |
| Capto adhere Eluate | 87 | 12.0 | 1.6/98.4/0.0 | 3.1 | ND/100/ND |

Figure 46A

| XENP | VH ID | VL ID | VH Substitutions | VL Substitutions |
|---|---|---|---|---|
| 11502 | H1 | L1.4 | | |
| 11794 | H1.3 | L1.4 | L11D | |
| 11795 | H1.4 | L1.4 | L11K | |
| 11796 | H1.5 | L1.4 | L11N | |
| 11801 | H1.6 | L1.4 | L11S | |
| 11802 | H1.7 | L1.4 | R19K | |
| 11803 | H1.8 | L1.4 | N30S | |
| 11804 | H1.9 | L1.4 | N35H | |
| 11805 | H1.10 | L1.4 | N35S | |
| 11806 | H1.11 | L1.4 | P41S | |
| 11807 | H1.12 | L1.4 | Y52CA | |
| 11808 | H1.13 | L1.4 | Y52CA/N54S | |
| 11809 | H1.14 | L1.4 | Y58A | |
| 11810 | H1.15 | L1.4 | D61A | |
| 11811 | H1.16 | L1.4 | D73N | |
| 11812 | H1.17 | L1.4 | D73T | |
| 11813 | H1.18 | L1.4 | L78A | |
| 11814 | H1.19 | L1.4 | A84D | |
| 11815 | H1.20 | L1.4 | A84K | |
| 11816 | H1.21 | L1.4 | A84S | |
| 11817 | H1.22 | L1.4 | V93A | |
| 11818 | H1.23 | L1.4 | V93T | |
| 11819 | H1.24 | L1.4 | N100D | |
| 11820 | H1.25 | L1.4 | N100Q | |
| 11821 | H1.26 | L1.4 | S100AT | |
| 11822 | H1.27 | L1.4 | A101D | |
| 11823 | H1.28 | L1.4 | L108T | |
| 11824 | H1.29 | L1.30 | G44S | G100S |
| 11825 | H1 | L1.10 | | E7P |
| 11826 | H1 | L1.11 | | T12S |
| 11827 | H1 | L1.12 | | G17A |
| 11828 | H1 | L1.13 | | G17Q |
| 11829 | H1 | L1.14 | | T29S |
| 11830 | H1 | L1.15 | | T29S/S30G/N31H |
| 11831 | H1 | L1.16 | | G49Y/G50D |
| 11832 | H1 | L1.17 | | K53N |
| 11833 | H1 | L1.18 | | P56S |
| 11834 | H1 | L1.19 | | N52S/K53N/R54K/A55H/P56S/G57W/V58T |
| 11835 | H1 | L1.20 | | A60D |
| 11836 | H1 | L1.21 | | L66K/L67S |
| 11837 | H1 | L1.22 | | L66S/L67S |

Figure 46B

| XENP | VH ID | VL ID | VH Substitutions | VL Substitutions |
|---|---|---|---|---|
| 11838 | H1 | L1.23 | | L75I |
| 11839 | H1 | L1.24 | | P80A |
| 11840 | H1 | L1.25 | | P80S |
| 11841 | H1 | L1.26 | | E85D |
| 11842 | H1 | L1.27 | | A89L |
| 11843 | H1 | L1.28 | | L95H |
| 11844 | H1 | L1.29 | | T105E/V106I/L106AK |
| 11920 | H1 | L3.1 | | |
| 11921 | H1 | L5.1 | | |
| 11922 | H1 | L1.31 | | L75D/E85D/L95H |
| 11923 | H1 | L1.32 | | Q38E |
| 12107 | H1.38 | L1.4 | V89T | |
| 12108 | H1 | L1.33 | | Q42K |
| 12109 | H1 | L1.34 | | Q42T |
| 12110 | H1 | L1.35 | | Q42S/A43P |
| 12111 | H1 | L1.36 | | A43P |
| 12112 | H1 | L1.37 | | A43G |
| 12113 | H1 | L1.38 | | A43S |
| 12114 | H1 | L1.39 | | A43D |
| 12131 | H1.30 | L1.4 | N30S/N100D | |
| 12132 | H1.31 | L1.4 | N30S/N35S/N100D | |
| 12133 | H1.32 | L1.4 | N30S/Y52CA/N100D | |
| 12134 | H1.33 | L1.4 | N30S/N100D/A101D | |
| 12135 | H1.34 | L1.4 | N30S/N35S/Y52CA/N100D/A101D | |
| 12136 | H1.35 | L1.4 | G10E/L11V/V12K/Q13K/G16E | |
| 12137 | H1.36 | L1.4 | K52BN/Y52C_/N53_/N54G/Y55G/A56S | |
| 12138 | H1.37 | L1.4 | Q39K | |
| 12139 | H1.37 | L1.32 | Q39K | Q38E |
| 12149 | H1 | L1.40 | | L75I/E85D/L95H |
| 12213 | H1.30 | L1.40 | N30S/N100D | L75I/E85D/L95H |
| 12214 | H1.8 | L1.40 | N30S | L75I/E85D/L95H |
| 12215 | H1.39 | L1.40 | N30S/Q39K | L75I/E85D/L95H |
| 12216 | H1.40 | L1.40 | N30S/Q39K/N100D | L75I/E85D/L95H |
| 12217 | H1.30 | L1.41 | N30S/N100D | L75I/L95H |
| 12218 | H1.8 | L1.41 | N30S | L75I/L95H |
| 12219 | H1.39 | L1.41 | N30S/Q39K | L75I/L95H |
| 12220 | H1.40 | L1.41 | N30S/Q39K/N100D | L75I/L95H |
| 12221 | H1.30 | L1.42 | N30S/N100D | L75I/Q42K/L95H |

Figure 46C

| XENP | VH ID | VL ID | VH Substitutions | VL Substitutions |
|---|---|---|---|---|
| 12222 | H1.8 | L1.42 | N30S | L75I/Q42K/L95H |
| 12223 | H1.39 | L1.42 | N30S/Q39K | L75I/Q42K/L95H |
| 12224 | H1.40 | L1.42 | N30S/Q39K/N100D | L75I/Q42K/L95H |
| 12225 | H1.30 | L1.43 | N30S/N100D | L75I/A43S/L95H |
| 12226 | H1.8 | L1.43 | N30S | L75I/A43S/L95H |
| 12227 | H1.39 | L1.43 | N30S/Q39K | L75I/A43S/L95H |
| 12228 | H1.40 | L1.43 | N30S/Q39K/N100D | L75I/A43S/L95H |
| 12229 | H1.30 | L1.44 | N30S/N100D | L75I/Q42K/A43S/L95H |
| 12230 | H1.8 | L1.44 | N30S | L75I/Q42K/A43S/L95H |
| 12231 | H1.39 | L1.44 | N30S/Q39K | L75I/Q42K/A43S/L95H |
| 12232 | H1.40 | L1.44 | N30S/Q39K/N100D | L75I/Q42K/A43S/L95H |
| 12233 | H1.30 | L1.45 | N30S/N100D | L75I/Q42K/E85D/L95H |
| 12234 | H1.8 | L1.45 | N30S | L75I/Q42K/E85D/L95H |
| 12235 | H1.39 | L1.45 | N30S/Q39K | L75I/Q42K/E85D/L95H |
| 12236 | H1.40 | L1.45 | N30S/Q39K/N100D | L75I/Q42K/E85D/L95H |
| 12237 | H1.30 | L1.46 | N30S/N100D | L75I/A43S/E85D/L95H |
| 12238 | H1.8 | L1.46 | N30S | L75I/A43S/E85D/L95H |
| 12239 | H1.39 | L1.46 | N30S/Q39K | L75I/A43S/E85D/L95H |
| 12240 | H1.40 | L1.46 | N30S/Q39K/N100D | L75I/A43S/E85D/L95H |
| 12241 | H1.30 | L1.47 | N30S/N100D | L75I/Q42K/A43S/E85D/L95H |
| 12242 | H1.8 | L1.47 | N30S | L75I/Q42K/A43S/E85D/L95H |
| 12243 | H1.39 | L1.47 | N30S/Q39K | L75I/Q42K/A43S/E85D/L95H |
| 12244 | H1.40 | L1.47 | N30S/Q39K/N100D | L75I/Q42K/A43S/E85D/L95H |

Figure 47A

αCD3_H1.31_L1.47 VH   (SEQ ID NO:529)

EVQLVESGGGLVQPGGSLRLSCAASG<u>FTFSTYA</u>MSWVRQAPGKGLEWVGRI<u>RSKYNNYA</u>TYYADSVKGRFTISRDDSK
NTLYLQMNSLRAEDTAVYYCVR<u>HGNFGDSYVSWFAY</u>WGQGTLVTVSS

αCD3_H1.31_L1.47 VL   (SEQ ID NO:530)

QAVVTQEPSLTVSPGGTVTLTCGSS<u>TGAVTTSNY</u>ANWVQQKPGKSPRGLIG<u>GTNKRAP</u>GVPARFSGSLLGGKAALTIS
GAQPEDEADYYCAL<u>WYSNHWV</u>FGGGTKLTVL

αCD3_H1.32_L1.47 VH   (SEQ ID NO:531)

EVQLVESGGGLVQPGGSLRLSCAASG<u>FTFSTYA</u>MNWVRQAPGKGLEWVGRI<u>RSKANNYA</u>TYYADSVKGRFTISRDDS
KNTLYLQMNSLRAEDTAVYYCVR<u>HGNFGDSYVSWFAY</u>WGQGTLVTVSS

αCD3_H1.32_L1.47 VL   (SEQ ID NO:532)

QAVVTQEPSLTVSPGGTVTLTCGSS<u>TGAVTTSNY</u>ANWVQQKPGKSPRGLIG<u>GTNKRAP</u>GVPARFSGSLLGGKAALTIS
GAQPEDEADYYCAL<u>WYSNHWV</u>FGGGTKLTVL

αCD3_H1.33_L1.47 VH   (SEQ ID NO:533)

EVQLVESGGGLVQPGGSLRLSCAASG<u>FTFSTYA</u>MNWVRQAPGKGLEWVGRI<u>RSKYNNYA</u>TYYADSVKGRFTISRDDSK
NTLYLQMNSLRAEDTAVYYCVR<u>HGNFGDSYVSWFDY</u>WGQGTLVTVSS

αCD3_H1.33_L1.47 VL   (SEQ ID NO:534)

QAVVTQEPSLTVSPGGTVTLTCGSS<u>TGAVTTSNY</u>ANWVQQKPGKSPRGLIG<u>GTNKRAP</u>GVPARFSGSLLGGKAALTIS
GAQPEDEADYYCAL<u>WYSNHWV</u>FGGGTKLTVL

αCD3_H1.89_L1.47 VH   (SEQ ID NO:535)

EVQLVESGGGLVQPGGSLRLSCAASG<u>FTFSTYA</u>MNWVRQAPGKGLEWVGRI<u>RSKYNNYA</u>TYYADSVKGRFTISRDDSK
NTLYLQMNSLRAEDTAVYYCVR<u>HGNFGDEYVSWFAY</u>WGQGTLVTVSS

αCD3_H1.89_L1.47 VL   (SEQ ID NO:536)

QAVVTQEPSLTVSPGGTVTLTCGSS<u>TGAVTTSNY</u>ANWVQQKPGKSPRGLIG<u>GTNKRAP</u>GVPARFSGSLLGGKAALTIS
GAQPEDEADYYCAL<u>WYSNHWV</u>FGGGTKLTVL

αCD3_H1.90_L1.47 VH   (SEQ ID NO:537)

EVQLVESGGGLVQPGGSLRLSCAASG<u>FTFSTYA</u>MNWVRQAPGKGLEWVGRI<u>RSKYNNYA</u>TYYADSVKGRFTISRDDSK
NTLYLQMNSLRAEDTAVYYCVR<u>HGNFGDPYVSWFAY</u>WGQGTLVTVSS

Figure 47B

αCD3_H1.90_L1.47 VL  (SEQ ID NO:538)

QAVVTQEPSLTVSPGGTVTLTCGSS<u>TGAVTTSNY</u>ANWVQQKPGKSPRGLIG<u>GTNKRAP</u>GVPARFSGSLLGGKAALTIS
GAQPEDEADYYCAL<u>WYSNHWV</u>FGGGTKLTVL

Figure 48

| XENP | CD38 affinity | αCD3 scFv-Fc | $K_D$ (nM)* | Fold Decrease in CD3 binding from H1.30_L1.47 |
|---|---|---|---|---|
| 13243 | low | H1.30_L1.47 | 4.91 | 1 |
| 14701 | low | H1.31_L1.47 | 1640 | 330 |
| 14702 | high | H1.31_L1.47 | 1640 | 330 |
| 14703 | v. low | H1.31_L1.47 | 1640 | 330 |

Figure 49

| Pool | DNA amount (%) | | | XENP13243 Heterodimer (%) | XENP13551 Heterodimer (%) |
|---|---|---|---|---|---|
| | Light chain | HC1 (Fab-Fc) | HC2 (scFv-Fc) | | |
| A | 47.4 | 31.6 | 21.1 | 65.6 | 57.6 |
| B | 42.9 | 28.6 | 28.6 | 61.2 | 83.5 |
| C | 37.5 | 25.0 | 37.5 | 96.2 | 90.5 |
| D | 33.3 | 22.2 | 44.4 | 92.8 | 84.4 |
| E | 54.5 | 27.3 | 18.2 | -- | 65.7 |
| F | 50.0 | 25.0 | 25.0 | 93.0 | 91.1 |
| G | 44.4 | 22.2 | 33.3 | 85.7 | 89.6 |
| H | 40.0 | 20.0 | 40.0 | 95.0 | 100.0 |

Figure 50
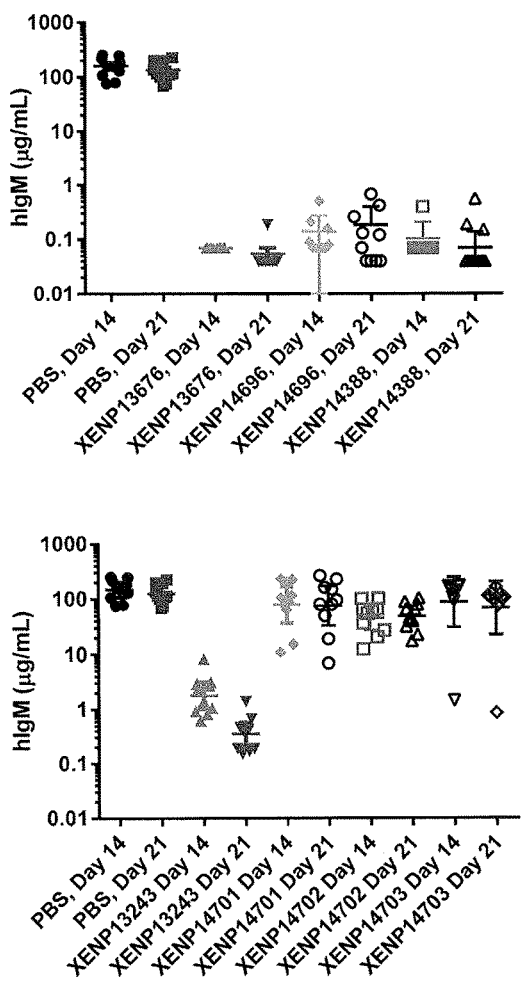
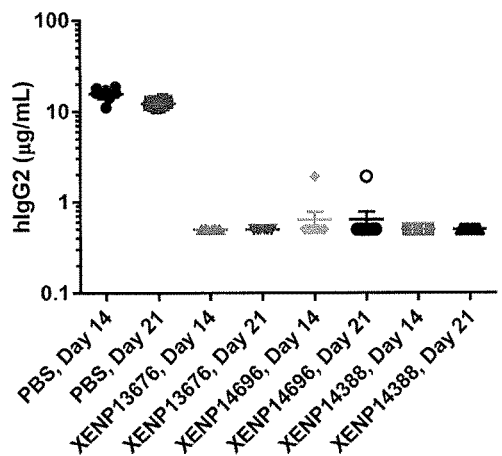
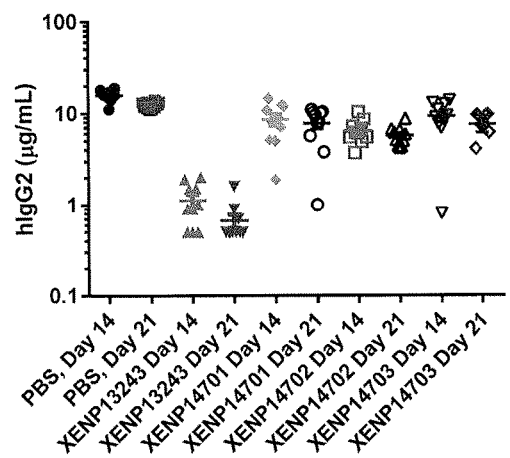

SEC after Protein A column

Figure 52C

| $K_D$ | Human CD38 | Cyno CD38 | Human CD3 | Cyno CD3 |
|---|---|---|---|---|
| XmAb13243 | 16.8 nM | 16.2 nM | 8.1 nM | 5.7 nM |
| XmAb13551 | 0.20 nM | 0.28 nM | As above | As above |
| Biacore, Ag coupled | | | | |

Figure 53
Bispecifics kill myeloma cells
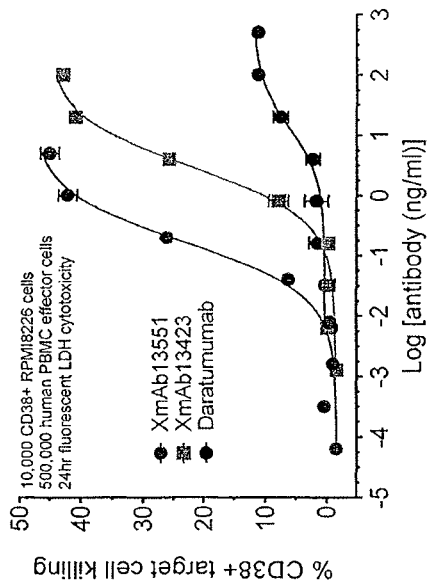
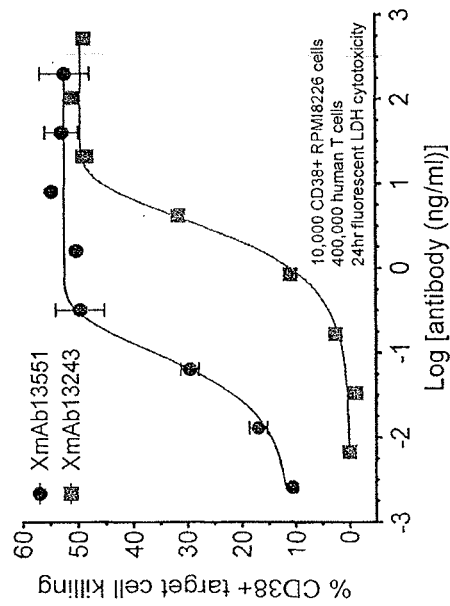

Greater hIg depletion vs daratumumab

Figure 61

| scFv monomer (+) | Fab monomer (-) |
|---|---|
| Heterodimer pI variants S364K/E357Q | Heterodimerization pI variants L368D/K370S |
| scFv charged linker (GKPGS)4 | Isosteric pI substitutions N208D/Q295E/N384D/Q418E/N421D |
| FcKO E233P/L234V/L235A/G236del/S267K | FcKO E233P/L234V/L235A/G236del/S267K |
| ± 428L/434S for FcRn | ± 428L/434S for FcRn |
| CD3 scFv | Fv sequences for anti-CD38 |

| scFv monomer | Fab monomer |
|---|---|
| Heterodimer pI variants S364K/E357Q | Heterodimerization pI variants L368D/K370S |
| scFv charged linker (GKPGS)4 | pI substitutions I199T N203D K274Q R355Q Q419E K447del |
| FcKO E233P/L234V/L235A/G236del/S267K | FcKO E233P/L234V/L235A/G236del/S267K |
| ± 428L/434S for FcRn (optional) | ± 428L/434S for FcRn (optional) |
| CD3 scFv | Fv sequences for anti-CD38 |

BISPECIFIC ANTIBODIES THAT BIND TO CD38 AND CD3

CROSS-REFERENCE TO RELATED APPLICATIONS

This application is a continuation of U.S. patent application Ser. No. 14/673,695 filed Mar. 30, 2015, which in turn claims priority under 35 U.S.C. § 119 to U.S. Provisional Patent Applications Nos. 61/972,172, filed Mar. 28, 2014, 62/025,974, filed Jul. 7, 2014, and 62/025,931, filed Jul. 17, 2014, the entire contents of which are incorporated herein for all purposes by this reference and specifically for the figures, legends and data outlined herein.

INCORPORATION BY REFERENCE OF A SEQUENCE LISTING SUBMITTED AS A TEXT FILE VIA EFS-WEB

This application contains, as a separate part of disclosure, a Sequence Listing in computer-readable form (filename: 50362A_Seqlisting.txt; Size: 934,047 bytes; created Jan. 22, 2020), which is incorporated by reference in its entirety.

TECHNICAL FIELD

The present invention describes novel immunoglobulin compositions that simultaneously co-engage antigens, where both of the antigens are bound monovalently. The novel immunoglobulins described preferably utilize heterodimeric Fc regions. Methods of using the novel immunoglobulin compositions, particularly for therapeutic purposes, are also described herein.

BACKGROUND OF THE INVENTION

Antibody-based therapeutics have been used successfully to treat a variety of diseases, including cancer and autoimmune/inflammatory disorders. Yet improvements to this class of drugs are still needed, particularly with respect to enhancing their clinical efficacy. One avenue being explored is the engineering of additional and novel antigen binding sites into antibody-based drugs such that a single immunoglobulin molecule co-engages two different antigens. Such non-native or alternate antibody formats that engage two different antigens are often referred to as bispecifics. Because the considerable diversity of the antibody variable region (Fv) makes it possible to produce an Fv that recognizes virtually any molecule, the typical approach to bispecific generation is the introduction of new variable regions into the antibody.

A number of alternate antibody formats have been explored for bispecific targeting (Chames & Baty, 2009, mAbs 1[6]:1-9; Holliger & Hudson, 2005, Nature Biotechnology 23[9]:1126-1136; and Kontermann, 2012 MAbs 4(2):182, all of which are expressly incorporated herein by reference). Initially, bispecific antibodies were made by fusing two cell lines that each produced a single monoclonal antibody (Milstein et al., 1983, Nature 305:537-540). Although the resulting hybrid hybridoma or quadroma did produce bispecific antibodies, they were only a minor population, and extensive purification was required to isolate the desired antibody. An engineering solution to this was the use of antibody fragments to make bispecifics. Because such fragments lack the complex quaternary structure of a full length antibody, variable light and heavy chains can be linked in single genetic constructs. Antibody fragments of many different forms have been generated, including diabodies, single chain diabodies, tandem scFv's, and $Fab_2$ bispecifics (Chames & Baty, 2009, mAbs 1[6]:1-9; Holliger & Hudson, 2005, Nature Biotechnology 23[9]:1126-1136; expressly incorporated herein by reference). While these formats can be expressed at high levels in bacteria and may have favorable penetration benefits due to their small size, they clear rapidly in vivo and can present manufacturing obstacles related to their production and stability. A principal cause of these drawbacks is that antibody fragments typically lack the constant region of the antibody with its associated functional properties, including larger size, high stability, and binding to various Fc receptors and ligands that maintain long half-life in serum (i.e., the neonatal Fc receptor FcRn) or serve as binding sites for purification (i.e., protein A and protein G).

More recent work has attempted to address the shortcomings of fragment-based bispecifics by engineering dual binding into full length antibody-like formats (Wu et al., 2007, Nature Biotechnology 25[11]:1290-1297; U.S. Ser. No. 12/477,711; Michaelson et al., 2009, mAbs 1[2]:128-141; PCT/US2008/074693; Zuo et al., 2000, Protein Engineering 13[5]:361-367; U.S. Ser. No. 09/865,198; Shen et al., 2006, J Biol Chem 281[16]:10706-10714; Lu et al., 2005, J Biol Chem 280[20]:19665-19672; PCT/US2005/025472; and Kontermann, 2012 MAbs 4(2): 182, all of which are expressly incorporated herein by reference). These formats overcome some of the obstacles of the antibody fragment bispecifics, principally because they contain an Fc region. One significant drawback of these formats is that, because they build new antigen binding sites on top of the homodimeric constant chains, binding to the new antigen is always bivalent.

For many antigens that are attractive as co-targets in a therapeutic bispecific format, the desired binding is monovalent rather than bivalent. For many immune receptors, cellular activation is accomplished by cross-linking of a monovalent binding interaction. The mechanism of cross-linking is typically mediated by antibody/antigen immune complexes, or via effector cell to target cell engagement. For example, the low affinity Fc gamma receptors (FcγRs) such as FcγRIIa, FcγRIIb, and FcγRIIIa bind monovalently to the antibody Fc region. Monovalent binding does not activate cells expressing these FcγRs; however, upon immune complexation or cell-to-cell contact, receptors are cross-linked and clustered on the cell surface, leading to activation. For receptors responsible for mediating cellular killing, for example FcγRIIIa on natural killer (NK) cells, receptor cross-linking and cellular activation occurs when the effector cell engages the target cell in a highly avid format (Bowles & Weiner, 2005, J Immunol Methods 304:88-99, expressly incorporated by reference). Similarly, on B cells the inhibitory receptor FcγRIIb downregulates B cell activation only when it engages into an immune complex with the cell surface B-cell receptor (BCR), a mechanism that is mediated by immune complexation of soluble IgG's with the same antigen that is recognized by the BCR (Heyman 2003, Immunol Lett 88[2]:157-161; Smith and Clatworthy, 2010, Nature Reviews Immunology 10:328-343; expressly incorporated by reference). As another example, CD3 activation of T-cells occurs only when its associated T-cell receptor (TCR) engages antigen-loaded MHC on antigen presenting cells in a highly avid cell-to-cell synapse (Kuhns et al., 2006, Immunity 24:133-139). Indeed nonspecific bivalent cross-linking of CD3 using an anti-CD3 antibody elicits a cytokine storm and toxicity (Perruche et al., 2009, J Immunol 183 [2]:953-61; Chatenoud & Bluestone, 2007, Nature Reviews Immunology 7:622-632; expressly incorporated by reference). Thus for practical clinical use, the preferred mode of CD3 co-engagement for redirected killing of targets cells is monovalent binding that results in activation only upon engagement with the co-engaged target.

CD38, also known as cyclic ADP ribose hydrolase, is a type II transmembrane glycoprotein with a long C-terminal extracellular domain and a short N-terminal cytoplasmic domain. Among hematopoietic cells, an assortment of functional effects have been ascribed to CD38 mediated signaling, including lymphocyte proliferation, cytokine release, regulation of B and myeloid cell development and survival, and induction of dendritic cell maturation. CD38 is unregulated in many hematopoeitic malignancies and in cell lines derived from various hematopoietic malignancies including non-Hodgkin's lymphoma (NHL), Burkitt's lymphoma (BL), multiple myeloma (MM), B chronic lymphocytic leukemia (B-CLL), B and T acute lymphocytic leukemia (ALL), T cell lymphoma (TCL), acute myeloid leukemia (AML), hairy cell leukemia (HCL), Hodgkin's Lymphoma (HL), and chronic myeloid leukemia (CML). On the other hand, most primitive pluripotent stem cells of the hematopoietic system are CD38–. In spite of the recent progress in the discovery and development of anti-cancer agents, many forms of cancer involving CD38-expressing tumors still have a poor prognosis. Thus, there is a need for improved methods for treating such forms of cancer.

Thus while bispecifics generated from antibody fragments suffer biophysical and pharmacokinetic hurdles, a drawback of those built with full length antibody-like formats is that they engage co-target antigens multivalently in the absence of the primary target antigen, leading to nonspecific activation and potentially toxicity. The present invention solves this problem by introducing a novel bispecific format that enables the co-engagement of distinct target antigens.

SUMMARY OF THE INVENTION

Accordingly, the present invention provides heterodimeric antibodies that bind to CD3 and CD38. The heterodimeric antibodies comprise a first heavy chain comprising a first variable Fc domain and a single chain Fv region (scFv) that binds CD3. The heterodimeric antibodies also comprise a second heavy chain comprising a second variable Fc domain and a first variable heavy domain. The heterodimeric antibodies further comprise a first light chain comprising a first variable light domain and a first constant light domain, wherein said first variable heavy domain and said first variable light domain bind to CD38.

In a further aspect the invention provides heterodimeric antibodies selected from the group consisting of XENP13243; XENP13545; XENP13546; XENP13547; XENP13548; XENP13549; XENP13550; XENP13551; XENP13544; XENP13752; XENP13753; XENP13754; XENP13756; XENP13757 and XENP13694.

In an additional aspect, the scFv has a sequence comprising a vhCDR1 having the sequence T-Y-A-M-Xaa1, wherein Xaa1 is N, S or H (SEQ ID NO:435), a vhCDR2 having the sequence R-I-R-S-K-Xaa1-N-Xaa2-Y-A-T-Xaa3-Y-Y-A-Xaa4-S-V-K-G, wherein Xaa1 is Y or A, Xaa2 is N or S, Xaa3 is Y or A and Xaa4 is D or A (SEQ ID NO:436), a vhCDR3 having the sequence H-G-N-F-G-Xaa1-S-Y-V-S-W-F-Xaa2-Y, wherein Xaa1 is N, D or Q and Xaa2 is A or D (SEQ ID NO:437), a vlCDR1 having the sequence Xaa1-S-S-T-G-A-V-T-Xaa2-Xaa3-Xaa4-Y-A-N, wherein Xaa1 is G, R or K, Xaa2 is T or S, Xaa3 is S or G and Xaa4 is N or H, (SEQ ID NO:438), a vlCDR2 having the sequence Xaa1-T-N-Xaa2-R-A-Xaa3, wherein Xaa1 is G or D, Xaa2 is K or N, and Xaa3 is P or S (SEQ ID NO:439) and a vlCDR3 having the sequence Xaa1-L-W-Y-S-N-Xaa2-W-V, wherein Xaa1 is A or L and Xaa2 is L or H (SEQ ID NO:440).

In a further aspect, the scFv is selected from the group consisting of H1.30_L1.47, H1.33_L1.47 and H1.31_L1.47.

In an additional aspect, the anti-CD3 variable region has a sequence selected from the group consisting of:

a) a sequence comprising a vhCDR1 having SEQ ID NO:411, a vhCDR2 having SEQ ID NO:413, a vhCDR3 having SEQ ID NO:416, a vlCDR1 having SEQ ID NO:420, a vlCDR2 having SEQ ID NO:425 and a vlCDR3 having SEQ ID NO:430;

b) a sequence comprising a vhCDR1 having SEQ ID NO:412, a vhCDR2 having SEQ ID NO:413, a vhCDR3 having SEQ ID NO:416, a vlCDR1 having SEQ ID NO:420, a vlCDR2 having SEQ ID NO:425 and a vlCDR3 having SEQ ID NO:430;

c) a sequence comprising a vhCDR1 having SEQ ID NO:411, a vhCDR2 having SEQ ID NO:414, a vhCDR3 having SEQ ID NO:416, a vlCDR1 having SEQ ID NO:420, a vlCDR2 having SEQ ID NO:425 and a vlCDR3 having SEQ ID NO:430;

d) a sequence comprising a vhCDR1 having SEQ ID NO:411, a vhCDR2 having SEQ ID NO:413, a vhCDR3 having SEQ ID NO:417, a vlCDR1 having SEQ ID NO:420, a vlCDR2 having SEQ ID NO:425 and a vlCDR3 having SEQ ID NO:430;

e) a sequence comprising a vhCDR1 having SEQ ID NO:411, a vhCDR2 having SEQ ID NO:413, a vhCDR3 having SEQ ID NO:418, a vlCDR1 having SEQ ID NO:420, a vlCDR2 having SEQ ID NO:425 and a vlCDR3 having SEQ ID NO:430;

f) a sequence comprising a vhCDR1 having SEQ ID NO:411, a vhCDR2 having SEQ ID NO:413, a vhCDR3 having SEQ ID NO:416, a vlCDR1 having SEQ ID NO:421, a vlCDR2 having SEQ ID NO:425 and a vlCDR3 having SEQ ID NO:430;

g) a sequence comprising a vhCDR1 having SEQ ID NO:411, a vhCDR2 having SEQ ID NO:413, a vhCDR3 having SEQ ID NO:416, a vlCDR1 having SEQ ID NO:422, a vlCDR2 having SEQ ID NO:425 and a vlCDR3 having SEQ ID NO:430;

h) a sequence comprising a vhCDR1 having SEQ ID NO:411, a vhCDR2 having SEQ ID NO:413, a vhCDR3 having SEQ ID NO:416, a vlCDR1 having SEQ ID NO:420, a vlCDR2 having SEQ ID NO:427 and a vlCDR3 having SEQ ID NO:430;

i) a sequence comprising a vhCDR1 having SEQ ID NO:411, a vhCDR2 having SEQ ID NO:413, a vhCDR3 having SEQ ID NO:416, a vlCDR1 having SEQ ID NO:420, a vlCDR2 having SEQ ID NO:428 and a vlCDR3 having SEQ ID NO:430;

j) a sequence comprising a vhCDR1 having SEQ ID NO:411, a vhCDR2 having SEQ ID NO:413, a vhCDR3 having SEQ ID NO:416, a vlCDR1 having SEQ ID NO:420, a vlCDR2 having SEQ ID NO:425 and a vlCDR3 having SEQ ID NO:431;

k) a sequence comprising a vhCDR1 having SEQ ID NO:411, a vhCDR2 having SEQ ID NO:413, a vhCDR3 having SEQ ID NO:416, a vlCDR1 having SEQ ID NO:420, a vlCDR2 having SEQ ID NO:425 and a vlCDR3 having SEQ ID NO:430;

l) a sequence comprising a vhCDR1 having SEQ ID NO:411, a vhCDR2 having SEQ ID NO:413, a vhCDR3 having SEQ ID NO:416, a vlCDR1 having SEQ ID NO:423, a vlCDR2 having SEQ ID NO:425 and a vlCDR3 having SEQ ID NO:432;

m) a sequence comprising a vhCDR1 having SEQ ID NO:411, a vhCDR2 having SEQ ID NO:413, a vhCDR3 having SEQ ID NO:416, a vlCDR1 having SEQ ID NO:424, a vlCDR2 having SEQ ID NO:425 and a vlCDR3 having SEQ ID NO:432;

n) a sequence comprising a vhCDR1 having SEQ ID NO:412, a vhCDR2 having SEQ ID NO:413, a vhCDR3 having SEQ ID NO:417, a vlCDR1 having SEQ ID NO:420, a vlCDR2 having SEQ ID NO:425 and a vlCDR3 having SEQ ID NO:430;

o) a sequence comprising a vhCDR1 having SEQ ID NO:412, a vhCDR2 having SEQ ID NO:414, a vhCDR3 having SEQ ID NO:419, a vlCDR1 having SEQ ID NO:420, a vlCDR2 having SEQ ID NO:425 and a vlCDR3 having SEQ ID NO:430;

p) a sequence comprising a vhCDR1 having SEQ ID NO:411, a vhCDR2 having SEQ ID NO:415, a vhCDR3 having SEQ ID NO:416, a vlCDR1 having SEQ ID NO:420, a vlCDR2 having SEQ ID NO:425 and a vlCDR3 having SEQ ID NO:430;

q) a sequence comprising a vhCDR1 having SEQ ID NO:411, a vhCDR2 having SEQ ID NO:415, a vhCDR3 having SEQ ID NO:416, a vlCDR1 having SEQ ID NO:420, a vlCDR2 having SEQ ID NO:425 and a vlCDR3 having SEQ ID NO:430;

r) a sequence comprising a vhCDR1 having SEQ ID NO:411, a vhCDR2 having SEQ ID NO:413, a vhCDR3 having SEQ ID NO:417, a vlCDR1 having SEQ ID NO:420, a vlCDR2 having SEQ ID NO:425 and a vlCDR3 having SEQ ID NO:430;

s) a sequence comprising a vhCDR1 having SEQ ID NO:411, a vhCDR2 having SEQ ID NO:413, a vhCDR3 having SEQ ID NO:419, a vlCDR1 having SEQ ID NO:420, a vlCDR2 having SEQ ID NO:425 and a vlCDR3 having SEQ ID NO:430;

t) a sequence comprising a vhCDR1 having SEQ ID NO:411, a vhCDR2 having SEQ ID NO:413, a vhCDR3 having SEQ ID NO:417, a vlCDR1 having SEQ ID NO:420, a vlCDR2 having SEQ ID NO:425 and a vlCDR3 having SEQ ID NO:433;

u) a sequence comprising a vhCDR1 having SEQ ID NO:411, a vhCDR2 having SEQ ID NO:413, a vhCDR3 having SEQ ID NO:416, a vlCDR1 having SEQ ID NO:420, a vlCDR2 having SEQ ID NO:425 and a vlCDR3 having SEQ ID NO:433 and v) a sequence comprising a vhCDR1 having SEQ ID NO:411, a vhCDR2 having SEQ ID NO:434, a vhCDR3 having SEQ ID NO:416, a vlCDR1 having SEQ ID NO:420, a vlCDR2 having SEQ ID NO:425 and a vlCDR3 having SEQ ID NO:430.

In an additional aspect, the anti-CD3 variable region comprises a variable heavy region and a variable light region selected from the group consisting of:

SEQ ID NOs: 5 and 6; SEQ ID NOs: 9 and 10; SEQ ID NOs: 13 and 14; SEQ ID NOs: 17 and 18; SEQ ID NOs: 21 and 22; SEQ ID NOs: 25 and 26; SEQ ID NOs: 29 and 30; SEQ ID NOs: 33 and 34; SEQ ID NOs: 37 and 38; SEQ ID NOs: 41 and 42; SEQ ID NOs: 45 and 46; SEQ ID NOs: 49 and 50; SEQ ID NOs: 53 and 54; SEQ ID NOs: 57 and 58; SEQ ID NOs: 61 and 62; SEQ ID NOs: 65 and 66; SEQ ID NOs: 69 and 70; SEQ ID NOs: 73 and 74; SEQ ID NOs: 77 and 78; SEQ ID NOs: 81 and 82; SEQ ID NOs: 85 and 86; SEQ ID NOs: 89 and 90; SEQ ID NOs: 93 and 94; SEQ ID NOs: 97 and 98; SEQ ID NOs: 101 and 102; SEQ ID NOs: 105 and 106; SEQ ID NOs: 109 and 110; SEQ ID NOs: 113 and 114; SEQ ID NOs: 117 and 118; SEQ ID NOs: 121 and 122; SEQ ID NOs: 125 and 126; SEQ ID NOs: 129 and 130; SEQ ID NOs: 133 and 134; SEQ ID NOs: 137 and 138; SEQ ID NOs: 141 and 142; SEQ ID NOs: 145 and 146; SEQ ID NOs: 149 and 150; SEQ ID NOs: 153 and 154; SEQ ID NOs: 157 and 158; SEQ ID NOs: 161 and 162; SEQ ID NOs: 165 and 166; SEQ ID NOs: 169 and 170; SEQ ID NOs: 173 and 174; SEQ ID NOs: 177 and 178; SEQ ID NOs: 181 and 182; SEQ ID NOs: 185 and 186; SEQ ID NOs: 189 and 190; SEQ ID NOs: 193 and 194; SEQ ID NOs: 197 and 198; SEQ ID NOs: 201 and 202; SEQ ID NOs: 205 and 206; SEQ ID NOs: 209 and 210; SEQ ID NOs: 213 and 214; SEQ ID NOs: 217 and 218; SEQ ID NOs: 221 and 222; SEQ ID NOs: 225 and 226; SEQ ID NOs: 229 and 230; SEQ ID NOs: 233 and 234; SEQ ID NOs: 237 and 238; SEQ ID NOs: 241 and 242; SEQ ID NOs: 245 and 246; SEQ ID NOs: 249 and 250; SEQ ID NOs: 253 and 254; SEQ ID NOs: 257 and 258; SEQ ID NOs: 261 and 262; SEQ ID NOs: 265 and 266; SEQ ID NOs: 269 and 270; SEQ ID NOs: 273 and 274; SEQ ID NOs: 277 and 278; SEQ ID NOs: 281 and 282; SEQ ID NOs: 285 and 286; SEQ ID NOs: 289 and 290; SEQ ID NOs: 293 and 294; SEQ ID NOs: 297 and 298; SEQ ID NOs: 301 and 302; SEQ ID NOs: 305 and 306; SEQ ID NOs: 309 and 310; SEQ ID NOs: 313 and 314; SEQ ID NOs: 317 and 318; SEQ ID NOs: 321 and 322; SEQ ID NOs: 325 and 326; SEQ ID NOs: 329 and 330; SEQ ID NOs: 333 and 334; SEQ ID NOs: 337 and 338; SEQ ID NOs: 341 and 342; SEQ ID NOs: 345 and 346; SEQ ID NOs: 349 and 350; SEQ ID NOs: 353 and 354; SEQ ID NOs: 357 and 358; SEQ ID NOs: 361 and 362; SEQ ID NOs: 365 and 366; SEQ ID NOs: 369 and 370; SEQ ID NOs: 373 and 374; SEQ ID NOs: 377 and 378; SEQ ID NOs: 381 and 382; SEQ ID NOs: 385 and 386; SEQ ID NOs: 389 and 390; SEQ ID NOs: 393 and 394; SEQ ID NOs: 397 and 398; SEQ ID NOs: 401 and 402; SEQ ID NOs: 405 and 406; SEQ ID NOs: 409 and 410.

In an additional aspect, the heterodimeric antibodies have the first variable heavy domain and the first variable light domain are selected from the pairs consisting of H1 and L1; H1 and L1.24; H1 and L1.96; H1.77 and L1.96; H1.77 and L1.97; H1.72 and L1.97; H1.71 and L1.96 and H1.77 and L1.24.

In a further aspect, the invention provides heterodimeric antibodies as above, wherein the scFv has a charged scFv linker. The charged scFv linker can have a positive charge from 3 to 8 and is selected from the group consisting of SEQ ID NOS: 443 to 451.

In an additional aspect, the scFv has a sequence selected from the group consisting of: SEQ ID NO: 4; SEQ ID NO: 8; SEQ ID NO: 12; SEQ ID NO: 16; SEQ ID NO: 20; SEQ ID NO: 24; SEQ ID NO: 28; SEQ ID NO: 32; SEQ ID NO: 36; SEQ ID NO: 40; SEQ ID NO: 44; SEQ ID NO: 48; SEQ ID NO: 52; SEQ ID NO: 56; SEQ ID NO: 60; SEQ ID NO: 64; SEQ ID NO: 68; SEQ ID NO: 72; SEQ ID NO: 76; SEQ ID NO: 80; SEQ ID NO: 84; SEQ ID NO: 88; SEQ ID NO: 92; SEQ ID NO: 96; SEQ ID NO: 100; SEQ ID NO: 104; SEQ ID NO: 108; SEQ ID NO: 112; SEQ ID NO: 116; SEQ ID NO: 120; SEQ ID NO: 124; SEQ ID NO: 128; SEQ ID NO: 132; SEQ ID NO: 136; SEQ ID NO: 140; SEQ ID NO: 144; SEQ ID NO: 148; SEQ ID NO: 152; SEQ ID NO: 156; SEQ ID NO: 160; SEQ ID NO: 164; SEQ ID NO: 168; SEQ ID NO: 172; SEQ ID NO: 176; SEQ ID NO: 180; SEQ ID NO: 184; SEQ ID NO: 188; SEQ ID NO: 192; SEQ ID NO: 196; SEQ ID NO: 200; SEQ ID NO: 204; SEQ ID NO: 208; SEQ ID NO: 212; SEQ ID NO: 216; SEQ ID NO: 220; SEQ ID NO: 224; SEQ ID NO: 228; SEQ ID NO: 232; SEQ ID NO: 236; SEQ ID NO: 240; SEQ ID NO: 244; SEQ ID NO: 248; SEQ ID NO: 252; SEQ ID NO: 256; SEQ ID NO: 260; SEQ ID NO: 264; SEQ ID NO: 268; SEQ ID NO: 272; SEQ ID NO: 276; SEQ ID NO: 280; SEQ ID NO: 284; SEQ ID NO: 288; SEQ ID NO: 292; SEQ ID NO: 296; SEQ ID NO: 300; SEQ ID NO: 304; SEQ ID NO: 308; SEQ ID NO: 312; SEQ ID NO: 316; SEQ ID NO: 320; SEQ ID NO: 324; SEQ ID NO: 328; SEQ ID NO: 332; SEQ ID NO: 336; SEQ ID NO: 340; SEQ ID NO: 344; SEQ ID NO: 348; SEQ ID NO: 352; SEQ ID NO: 356; SEQ ID NO: 360; SEQ ID NO: 364; SEQ ID NO: 368; SEQ ID NO: 372; SEQ ID NO: 376; SEQ ID NO: 380; SEQ ID NO: 384; SEQ ID NO: 388; SEQ ID NO: 392; SEQ ID NO: 396; SEQ ID NO: 400; SEQ ID NO: 404; SEQ ID NO: 408.

In a further aspect, the Fc region of the heavy chains further comprises an FcRn variant, including but not limited to 428L/434S.

In an additional aspect, the invention provides nucleic acid compositions comprising a first nucleic acid encoding a first heavy chain comprising an Fc region and a scFv that binds to CD3, a second nucleic acid encoding a second heavy chain that comprises a heavy constant chain and a heavy variable chain, and a third nucleic acid encoding a light chain, wherein the Fv regions of the second heavy chain and the light chain bind CD38. These nucleic acids can be in different expression vectors or the same. The invention provides host cells comprising the nucleic acid compositions.

In a further aspect, the invention provides methods of producing heterodimeric antibodies of the invention comprising providing a first expression vector comprising a first nucleic acid encoding a first heavy chain comprising a first Fc domain and a first variable heavy chain; providing a second expression vector comprising a second nucleic acid encoding a second heavy chain comprising a first Fc domain and a single chain Fv region (scFv) that binds CD3; and providing a third expression vector comprising nucleic acid comprising a light chain; wherein said first variable heavy chain and the variable light domain of said light chain bind CD38. The first, second and third expression vectors are transfected into host cells at a ratio selected from the group consisting of 1:1.5:1.5, 1:2:1.5, 1:0.667:2, 1:1:2, 1:1.5:2, and 1:2:2. The first, second and third nucleic acids in the host cells produce a first, second and third amino acid sequence, respectively, such that said first, second and third amino acid sequences form heterodimeric antibody.

In an additional aspect, the invention provides methods of treating a patient in need thereof by administering a heterodimeric antibody according to the invention.

BRIEF DESCRIPTION OF THE DRAWINGS

FIGS. 1A and 1B depict the sequence of human CD38. FIG. 1A depicts the full length sequence and FIG. 1B depicts the extracellular domain.

FIG. 2 depicts the sequence of human CD3.

FIGS. 3A to 3YY depict the amino acid sequences of stability-optimized, humanized anti-CD3 variant scFvs, variable heavy and variable light sequences. (Note also that the first sequence is the histidine tagged version for ease of purification). CDRs are underlined. It should be understood that the increased stability of the optimized variable and optimized light chains (as well as the scFv chains) can be attributed to framework regions as well as the CDRs. Thus, it should be understood that the disclosure of the entire variable region includes the disclosure of the framework regions, although they are not separately numbered. In addition, the scFv linkers are shown in grey. Each scFv linker can be replaced with a charged scFv linker as depicted in FIG. 5. That is, any charged scFv linker, whether positive or negative, including those depicted in FIG. 5 can be substituted for the highlighted region in FIGS. 3A to 3YY.

FIGS. 4A to 4I depict a collation of all the CD3 vhCDR1-3 and vlCDR1-3 sequences useful in the present invention and consensus CDRs.

FIG. 5 depicts suitable positive and negatively charged scFv linkers. A single prior art scFv linker with a single charge is referenced as "Whitlow", from Whitlow et al., Protein Engineering 6(8):989-995 (1993). It should be noted that this linker was used for reducing aggregation and enhancing proteolytic stability in scFvs.

FIGS. 6A, 6B, 6C and 6D depict novel steric variants. As will be understood by those in the art, the first column of each table represents "corresponding" monomer pairs; that is, monomer 1 has 405A and the corresponding steric variant is 394F. It is important to note that in the context of the asymmetrical triple F format, either monomer can have either variant. That is, the scFv monomer can be monomer 1 or monomer 2. Again, these sets can be optionally and independently combined with other steric variants as well as other heterodimerization variants including charge pairs, isotypic variants, isosteric variants, pI variants, etc, as long as some "strandedness" is maintained. In addition, the "monomer" refers to the Fc domains; that is, in the triple F format, one monomer is the scFv construct and the other monomer is the Fab construct, despite the fact that there are actually two amino acid sequences that comprise the Fab construct (the heavy and light chains). show a number of suitable steric or "skew" variants of use in the present invention. FIG. 6 depicts a number of steric variants that can be used alone or in combination with pI variants (as is true of all the variants in FIG. 6); however, as will be appreciated by those in the art, if there are pI variants, the "strandedness" of the pI variants and steric variants should be maintained. That is, if for example the pI variants S364K/E357Q (monomer 1) and L368D/K370S (monomer 2) are to be combined with FIG. 29C variants, the pI of the steric variants should be considered and assigned to the correct monomer. That is, steric variants that alter charge (T411E) for example, are added to the "negative" monomer.

FIG. 7 depicts a list of engineered heterodimer-skewing (e.g. "steric heterodimerization") Fc variants with heterodimer yields (determined by HPLC-CIEX) and thermal stabilities (determined by DSC). Not determined thermal stability is denoted by "n.d.".

FIG. 8A shows a scFv-Fc format. FIG. 8C depicts a more standard bispecific format, also utilizing the pI variants of the invention (and optionally and independently the other heterodimerization variants). FIG. 8B shows the "triple F" format (sometimes also referred to as the "bottle-opener" configuration; (and optionally and independently the other heterodimerization variants). Many of the embodiments listed herein have the anti-CD3 component of the bispecific antibody as the scFv, and the anti-CD38 component as the Fab fragment, although as will be appreciated by those in the art, these may be switched, with the anti-CD38 component being the scFv, optionally with a charged linker, and the Fv regions of the scFv of the anti-CD3 sequences herein being reengineered to be Fab fragments.

FIG. 9 depicts a number of suitable "knock out" ("KO") variants to reduce binding to some or all of the FcγR receptors. As is true for many if not all variants herein, these KO variants can be independently and optionally combined, both within the set described in FIG. 9 and with any heterodimerization variants outlined herein, including steric and pI variants. For example, E233P/L234V/L235A/G236del can be combined with any other single or double variant from the list. In addition, while it is preferred in some embodiments that both monomers contain the same KO variants, it is possible to combine different KO variants on different monomers, as well as have only one monomer comprise the KO variant(s). Reference is also made to the Figures and Legends of U.S. Ser. No. 61/913,870, all of which is expressly incorporated by reference in its entirety as it relates to "knock out" or "ablation" variants.

FIG. 10 shows a list of engineered heterodimer-skewing Fc variants with heterodimer yields (determined by HPLC-CIEX) and thermal stabilities (determined by DSC). Not determined thermal stability is denoted by "n.d.".

FIG. 15. Table listing properties of affinity/stability engineered variant Anti-CD38×Anti-CD3 bispecific molecules. Numbering is according to Kabat.

FIG. 20A-20Q shows the sequences of the CD38×CD3 scFv bottle openers of the invention.

FIG. 21 shows the variants of some useful Fc domains of the CD38×CD3 bottle openers.

FIGS. 22A and 22B depict the amino acid sequences for anti-CD38×anti-CD3 bispecifics XENP13243 and XENP13551, with the CDRs underlined and the charged linker (which may be uncharged or substituted with any other charged linker, either positive or negative, from FIG. 7).

FIGS. 23A, 23B, 23C and 23D show DNA sequences encoding anti-CD38×anti-CD3 bispecifics XENP13243 and XENP13551.

FIG. 24 shows the DNA transfection ratio chart for stable pool generation for XENP13243 and XENP13551. Relative amounts of transfected DNA for HC-Fab, HC-scFv, and LC are listed.

FIG. 26. Summary of different protein species generated by stable pools as identified by the cation exchange chromatograms shown in FIG. 25. DNA transfection ratios are as listed in FIG. 24.

FIG. 29. Kinetics of human and cyno CD38 and CD3 binding to XENP13243 and XENP13551, as determined by surface plasmon resonance. Assay format is as specified.

FIG. 32 depicts a list of isosteric variant antibody constant regions and their respective substitutions. pI_(−) indicates lower pI variants, while pI_(+) indicates higher pI variants. These can be optionally and independently combined with other heterodimerization variants of the invention.

FIG. 33 shows some charged linkers and data for particular anti-CD3 scFvs.

FIG. 34 depicts a schematic associated with the use of separation variants, also referred to herein as "pI variants", and combined with the heterodimer assembly variants, also referred to herein as "skew variants". These variants can be used in a "plug and play" format, in that the effects of the variants transfer into different antibodies with different Fv regions easily and are very stable.

FIG. 36 depicts the use of an Fc knock-out (or ablation variant) that retains wild type stability but removing all FcγR binding.

FIG. 41 shows the CD38+ cell depletion correlates with T cell redistribution and activation.

FIG. 43 shows some cell culture optimization for improved yield, with titers of ≥3 g/L being obtained, with no significant difference in heterodimer/homodimer ratios being seen from scale up.

FIG. 44 shows the analytical results from the three step process of manufacturing. The process produces high yields, over 55%, of very pure heterodimeric bispecific molecules, and effectively removes homodimeric, HMW and LMW contaminants as well as HCP.

FIG. 45A-45U shows a variety of additional heterodimerization formats, any one of which can include the anti-CD3 and anti-CD38 sequences of the invention. FIGS. 45A to 45U depicts a wide variety of the multispecific (e.g. heterodimerization) formats and the combinations of different types of heterodimerization variants that can be used in the present invention (these are sometimes referred to herein as "heterodimeric scaffolds"). Note in addition that all of these formats can include addition variants in the Fc region, as more fully discussed below, including "ablation" or "knock out" variants (FIG. 7), Fc variants to alter FcγR binding (FcγRIIb, FcγRIIIa, etc.), Fc variants to alter binding to FcRn receptor, etc. FIG. 45A shows a dual scFv-Fc format, that, as for all heterodimerization formats herein can include heterodimerization variants such as pI variants, knobs in holes (KIH, also referred to herein as steric variants or "skew" variants), charge pairs (a subset of steric variants), isosteric variants, and SEED body ("strand-exchange engineered domain"; see Klein et al., mAbs 4:6 653-663 (2012) and Davis et al, Protein Eng Des Sel 2010 23:195-202) which rely on the fact that the CH3 domains of human IgG and IgA do not bind to each other. FIG. 45O is a "BiTE" or scFv-scFv linked by a linker as outlined herein, FIG. 45P depicts a DART, FIG. 45Q depicts a TandAb, and FIG. 45R shows a diabody. FIGS. 45S, 45T and 45U depict additional alternative scaffold formats that find use in the present invention.

FIGS. 46A, 46B and 46C depict stability-optimized, humanized anti-CD3 variant scFvs. Substitutions are given relative to the H1.1_L1.4 scFv sequence. Amino acid numbering is Kabat numbering.

FIGS. 47A and 47B. Variable heavy and variable light chains for anti-CD3 sequences of use in the present invention, include both "strong" and "lower" binding sequences. As will be appreciated by those in the art, these can be used in Fab or scFv constructs in combination with any target tumor antigen binding domains.

FIG. 50 Human IgM and IgG2 depletion by anti-CD38× anti-CD3 bispecifics in a huPBMC mouse model.

FIGS. 52A, 52B and 52C show the binding to human and monkey CD38 and CD3, and the Kd.

FIG. 53 shows the killing of myeloma cells.

FIG. 60A (redistribution from blood), FIG. 60B (CD69 induction) and FIG. 60C (cytokine release) shows CD38+ cell depletion correlates with T cell redistribution & activation.

FIG. 61 depicts several embodiments of particular use in the present invention.

DETAILED DESCRIPTION OF THE INVENTION

I. Overview

Figure 8:
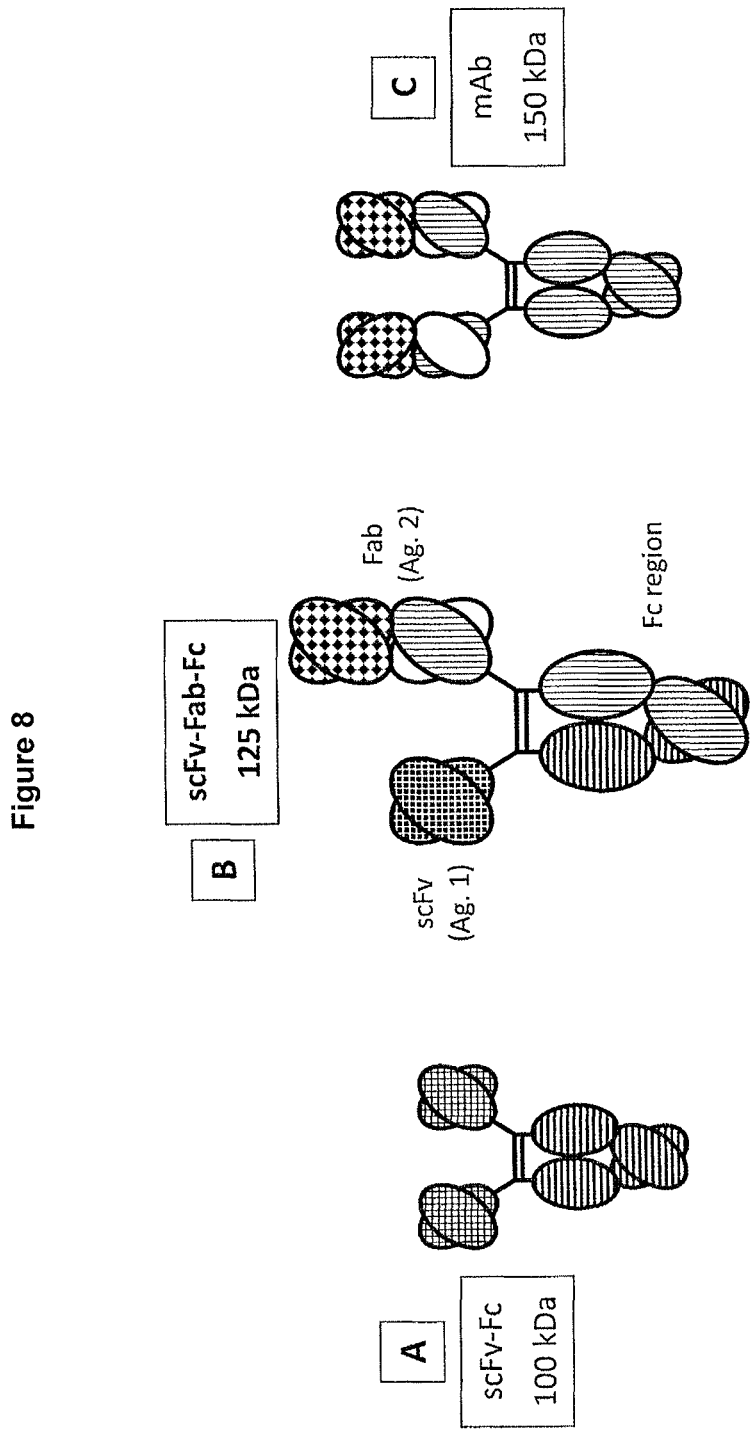
FIG. 8A to 8C. Illustration of the "triple F" format for bispecific immunoglobulins.

The present invention is directed to novel constructs to provide bispecific antibodies that bind to both CD3 and CD38 antigens. An ongoing problem in antibody technologies is the desire for "bispecific" (and/or multispecific) antibodies that bind to two (or more) different antigens simultaneously, in general thus allowing the different antigens to be brought into proximity and resulting in new functionalities and new therapies. In general, these antibodies are made by including genes for each heavy and light chain into the host cells. This generally results in the formation of the desired heterodimer (A-B), as well as the two homodimers (A-A and B-B). However, a major obstacle in the formation of multispecific antibodies is the difficulty in purifying the heterodimeric antibodies away from the homodimeric antibodies and/or biasing the formation of the heterodimer over the formation of the homodimers.

The present invention is generally directed to the creation of heterodimeric proteins such as antibodies that can co-engage antigens in several ways, relying on amino acid variants in the constant regions that are different on each chain to promote heterodimeric formation and/or allow for ease of purification of heterodimers over the homodimers.

Thus, the present invention is directed to novel immunoglobulin compositions that co-engage at least a first and a second antigen. First and second antigens of the invention are herein referred to as antigen-1 and antigen-2 respectively. One heavy chain of the antibody contains an single chain Fv ("scFv", as defined below) and the other heavy chain is a "regular" FAb format, comprising a variable heavy chain and a light chain. This structure is sometimes referred to herein as "triple F" format (scFv-FAb-Fc) or the "bottle-opener" format, due to a rough visual similarity to a bottle-opener (see Figure). The two chains are brought together by the use of amino acid variants in the constant regions (e.g. the Fc domain and/or the hinge region) that promote the formation of heterodimeric antibodies as is described more fully below.

There are several distinct advantages to the present "triple F" format. As is known in the art, antibody analogs relying on two scFv constructs often have stability and aggregation problems, which can be alleviated in the present invention by the addition of a "regular" heavy and light chain pairing. In addition, as opposed to formats that rely on two heavy chains and two light chains, there is no issue with the incorrect pairing of heavy and light chains (e.g. heavy 1 pairing with light 2, etc.)

There are a number of mechanisms that can be used to generate the heterodimers of the present invention. In addition, as will be appreciated by those in the art and described more fully below, these mechanisms can be combined to ensure high heterodimerization.

One mechanism is generally referred to in the art as "knobs and holes" ("KIH"), or sometimes herein as "skew" variants, referring to amino acid engineering that creates steric influences to favor heterodimeric formation and disfavor homodimeric formation can also optionally be used; this is sometimes referred to as "knobs and holes", as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. The figures identify a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g. these are "monomer corresponding sets) and C220E/P228E/368E paired with C220R/E224R/P228R/K409R. (Note the 220 mutation is to remove a cysteine no longer needed for heavy and light chain disulfide formation, as more fully described below).

In the present invention, there are several basic mechanisms that can lead to ease of purifying heterodimeric proteins; one relies on the use of pI variants, such that each monomer has a different pI, thus allowing the isoelectric purification of A-A, A-B and B-B dimeric proteins. Alternatively, the "triple F" format also allows separation on the basis of size. As is further outlined below, it is also possible to "skew" the formation of heterodimers over homodimers, as is generally outlined below. Thus, a combination of steric heterodimerization variants and pI or charge pair variants find particular use in the invention. Additionally, as more fully outlined below, the scFv monomer of the Triple F format can include charged scFv linkers (either positive or negative), that give a further pI boost for purification purposes. As will be appreciated by those in the art, some Triple F formats are useful with just charged scFv linkers and no additional pI adjustments, although the invention does provide the use of skew variants with charged scFv linkers as well (and combinations of Fc, FcRn and KO variants).

In the present invention that utilizes pI as a separation mechanism to create the heterodimeric Triple F format, amino acid variants can be introduced into one or both of the monomer polypeptides; that is, the pI of one of the monomers (referred to herein for simplicity as "monomer A") can be engineered away from monomer B, or both monomer A and B change be changed, with the pI of monomer A increasing and the pI of monomer B decreasing. As is outlined more fully below, the pI changes of either or both monomers can be done by removing or adding a charged residue (e.g. a neutral amino acid is replaced by a positively or negatively charged amino acid residue, e.g. glycine to glutamic acid), changing a charged residue from positive or negative to the opposite charge (aspartic acid to lysine) or changing a charged residue to a neutral residue (e.g. loss of a charge; lysine to serine). A number of these variants are shown in the Figures.

Accordingly, in this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease it's pI (wt A–+B or wt A––B), or by increasing one region and decreasing the other region (A+–B– or A–B+). It should be noted that in this discussion it does not matter which monomer comprises the scFv and which the Fab.

Thus, in general, a component of the present invention are amino acid variants in the constant regions of antibodies that are directed to altering the isoelectric point (pI) of at least one, if not both, of the monomers of a dimeric protein to form "pI heterodimers" (when the protein is an antibody, these are referred to as "pI antibodies") by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the scFv and Fab of interest. That is, to determine which monomer to engineer or in which "direction" (e.g. more positive or more negative), the Fv sequences of the two target antigens are calculated and a decision is made from there. As is known in the art, different Fvs will have different starting pIs which are exploited in the present invention. In general, as outlined herein, the pIs are engineered to result in a total pI difference of each monomer of at least about 0.1 logs, with 0.2 to 0.5 being preferred as outlined herein.

Furthermore, as will be appreciated by those in the art and outlined herein, heterodimers can be separated from homodimers on the basis of size. For example, as shown in FIG. 8, heterodimers with two scFvs (FIG. 8A) can be separated by those of the "triple F" format (FIG. 8B) and a bispecific mAb (FIG. 8C). This can be further exploited in higher valency with additional antigen binding sites being utilized. For example, as additionally shown, one monomer will have two Fab fragments and the other will have one scFv, resulting in a differential in size and thus molecular weight.

In addition, as will be appreciated by those in the art and outlined herein, the format outlined herein can be expanded to provide trispecific and tetraspecific antibodies as well. In this embodiment, some variations of which are depicted in the Figures, it will be recognized that it is possible that some antigens are bound divalently (e.g. two antigen binding sites to a single antigen; for example, A and B could be part of a typical bivalent association and C and D can be optionally present and optionally the same or different). As will be appreciated, any combination of Fab and scFvs can be utilized to achieve the desired result and combinations.

In the case where pI variants are used to achieve heterodimerization, by using the constant region(s) of the heavy chain(s), a more modular approach to designing and purifying multispecific proteins, including antibodies, is provided. Thus, in some embodiments, heterodimerization variants (including skew and purification heterodimerization variants) are not included in the variable regions, such that each individual antibody must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g. the minimization or avoidance of non-human residues at any particular position.

In one embodiment, the heterodimeric antibody provides for monovalent engagement of one antigen using a scFv and monovalent engagement of the other antigen using a FAb. As outlined below, this format can also be varied; in some embodiments, there is monovalent engagement of three antigens, divalent engagement of one antigen and monovalent engagement of a second antigen (e.g. A and C are to the same antigen and B is to a different antigen), etc.

A side benefit that can occur with this pI engineering is also the extension of serum half-life and increased FcRn binding. That is, as described in U.S. Ser. No. 13/194,904 (incorporated by reference in its entirety), lowering the pI of antibody constant domains (including those found in antibodies and Fc fusions) can lead to longer serum retention in vivo. These pI variants for increased serum half life also facilitate pI changes for purification.

Furthermore, as outlined herein, additional amino acid variants may be introduced into the bispecific antibodies of the invention, to add additional functionalities. For example, amino acid changes within the Fc region can be added (either to one monomer or both) to facilitiate increased ADCC or CDC (e.g. altered binding to Fcγ receptors); to allow or increase yield of the addition of toxins and drugs (e.g. for ADC), as well as to increase binding to FcRn and/or increase serum half-life of the resulting molecules. As is further described herein and as will be appreciated by those in the art, any and all of the variants outlined herein can be optionally and independently combined with other variants.

Similarly, another category of functional variants are "Fcγ ablation variants" or "Fc knock out (FcKO or KO) variants. In these embodiments, for some therapeutic applications, it is desirable to reduce or remove the normal binding of the Fc domain to one or more or all of the Fcγ receptors (e.g. FcγR1, FcγRIIa, FcγRIIb, FcγRIIIa, etc.) to avoid additional mechanisms of action. That is, for example, in many embodiments, it is generally desirable to ablate FcγRIIIa binding to eliminate or significantly reduce ADCC activity.

In addition, the invention provides novel humanized anti-CD3 sequences, including sets of CDRs, full variable light and heavy chains, as well as the associated scFvs, which can optionally include charged scFv linkers. These optimized sequences can be used in other antibody formats.

The invention further provides novel anti-CD38 sequences, including sets of CDRs, full variable light and heavy chains, as well as the associated scFvs, which can optionally include charged scFv linkers. These optimized sequences can be used in other antibody formats.

Accordingly, the present invention provides novel constructs to produce bispecific, bivalent antibodies that bind to both CD3 and CD38.

Figure 45A:
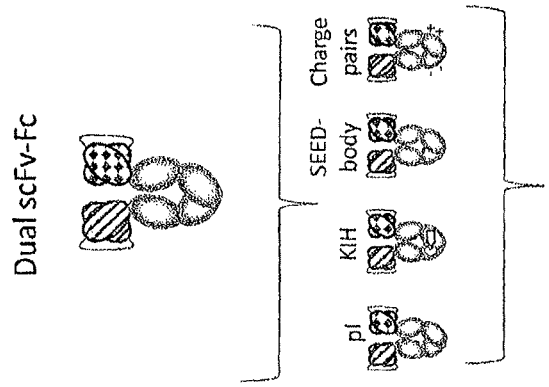
Figure 45B:
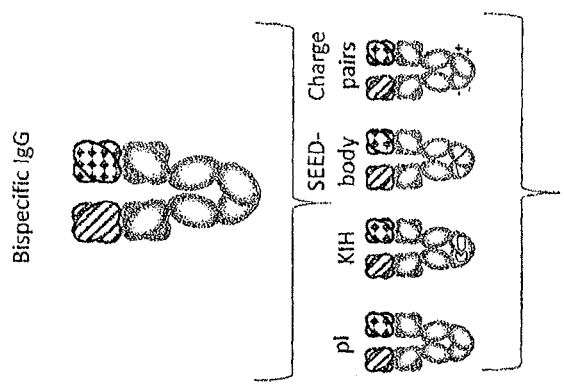
FIG. 45B depicts a bispecific IgG, again with the option of a variety of heterodimerization variants.
Figures 45C, 45D, 45E, 45F:
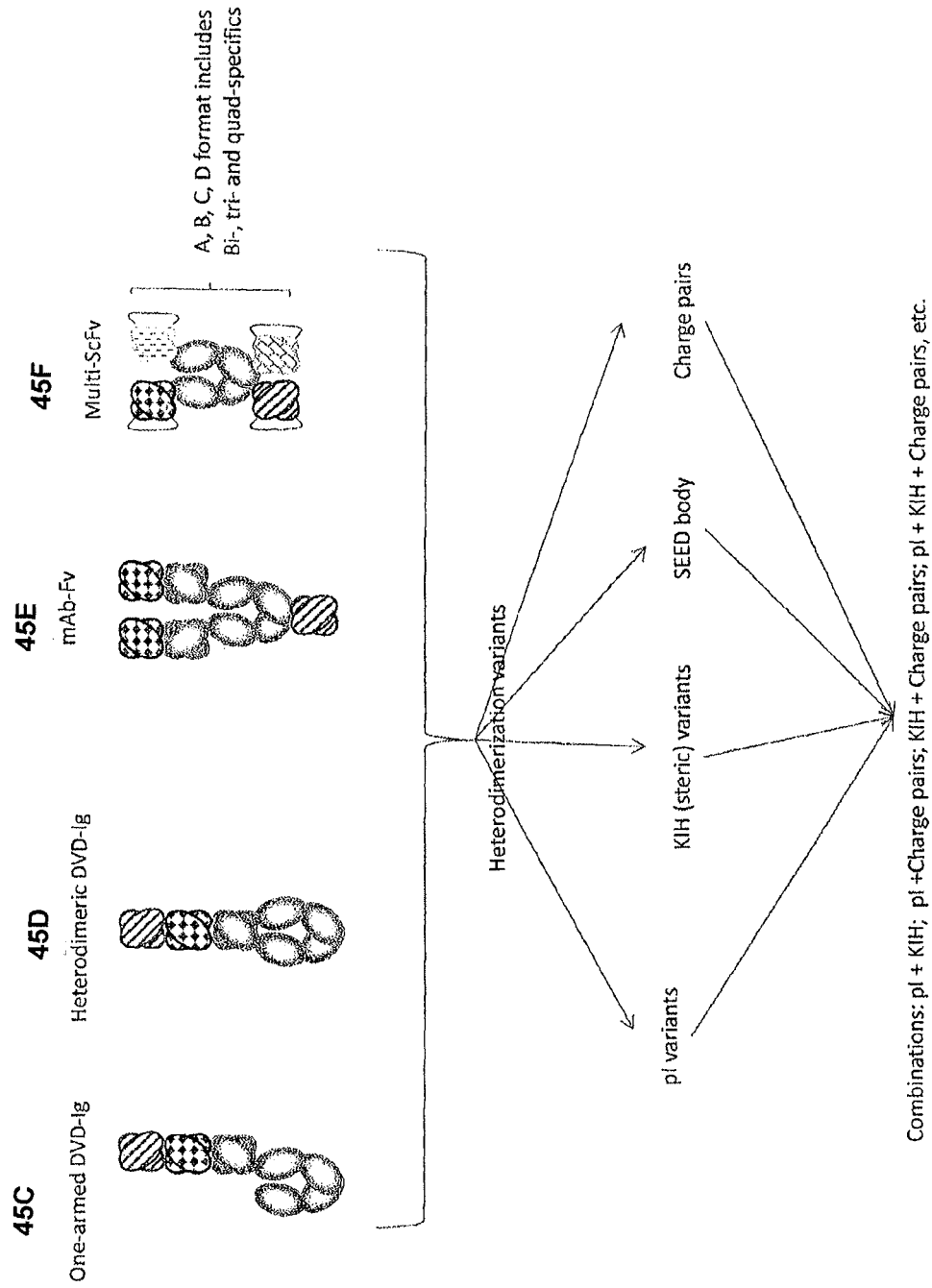
FIG. 45C depicts the "one armed" version of DVD-Ig which utilizes two different variable heavy and variable light domains.
FIG. 45D is similar, except that rather than an "empty arm", the variable heavy and light chains are on opposite heavy chains.
FIG. 45E is generally referred to as "mAb-Fv".
FIG. 45F depicts a multi-scFv format; as will be appreciated by those in the art, similar to the "A, B, C, D" formats discussed herein, there may be any number of associated scFvs (or, for that matter, any other binding ligands or functionalities). Thus, FIG. 45F could have 1, 2, 3 or 4 scFvs (e.g. for bispecifics, the scFv could be "cis" or "trans", or both on one "end" of the molecule).
Figures 45G, 45H, 45I, 45J:
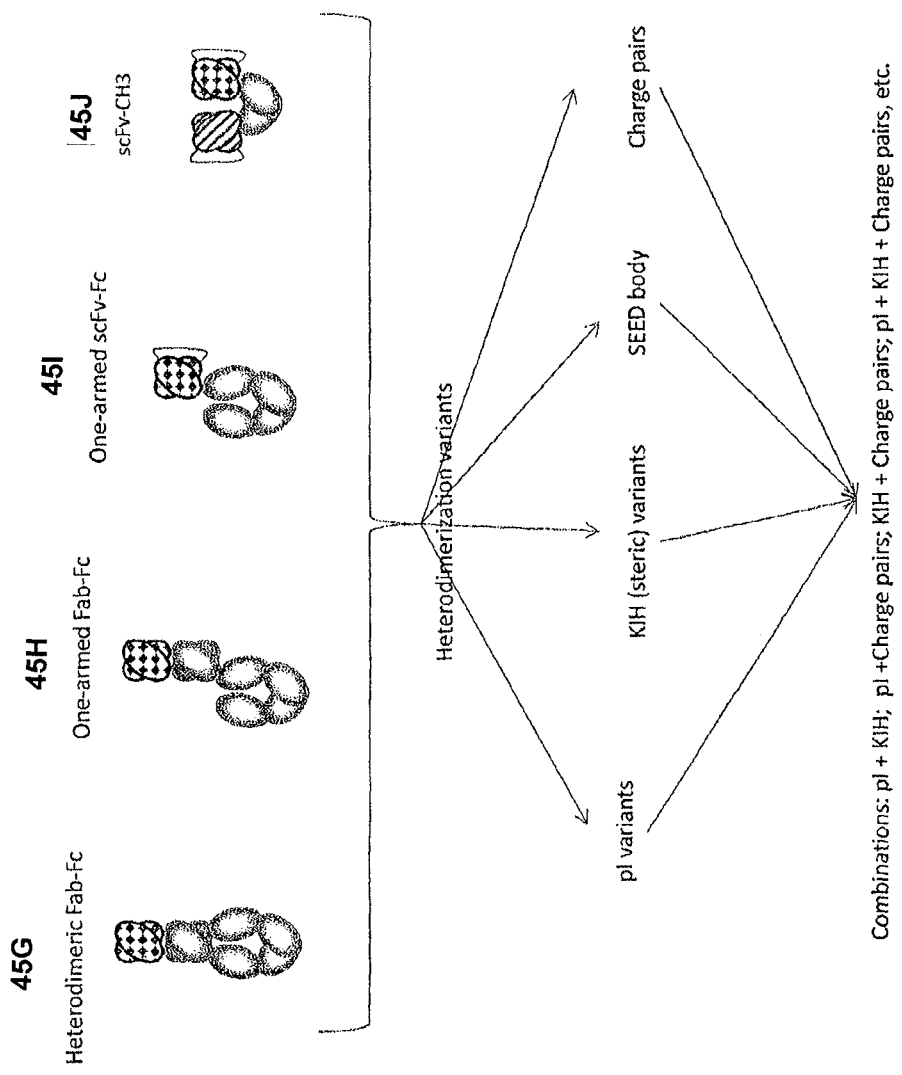
FIG. 45G depicts a heterodimeric FabFc with the Fab being formed by two different heavy chains one containing heavy chain Fab sequences and the other containing light chain Fab sequences.
FIG. 45H depicts the "one armed Fab-Fc", where one heavy chain comprises the Fab.
FIG. 45I depicts a "one armed scFv-Fc", wherein one heavy chain Fc comprises an scFv and the other heavy chain is "empty".
FIG. 45J shows a scFv-CH3, wherein only heavy chain CH3 regions are used, each with their own scFv.
Figures 45K, 45L:
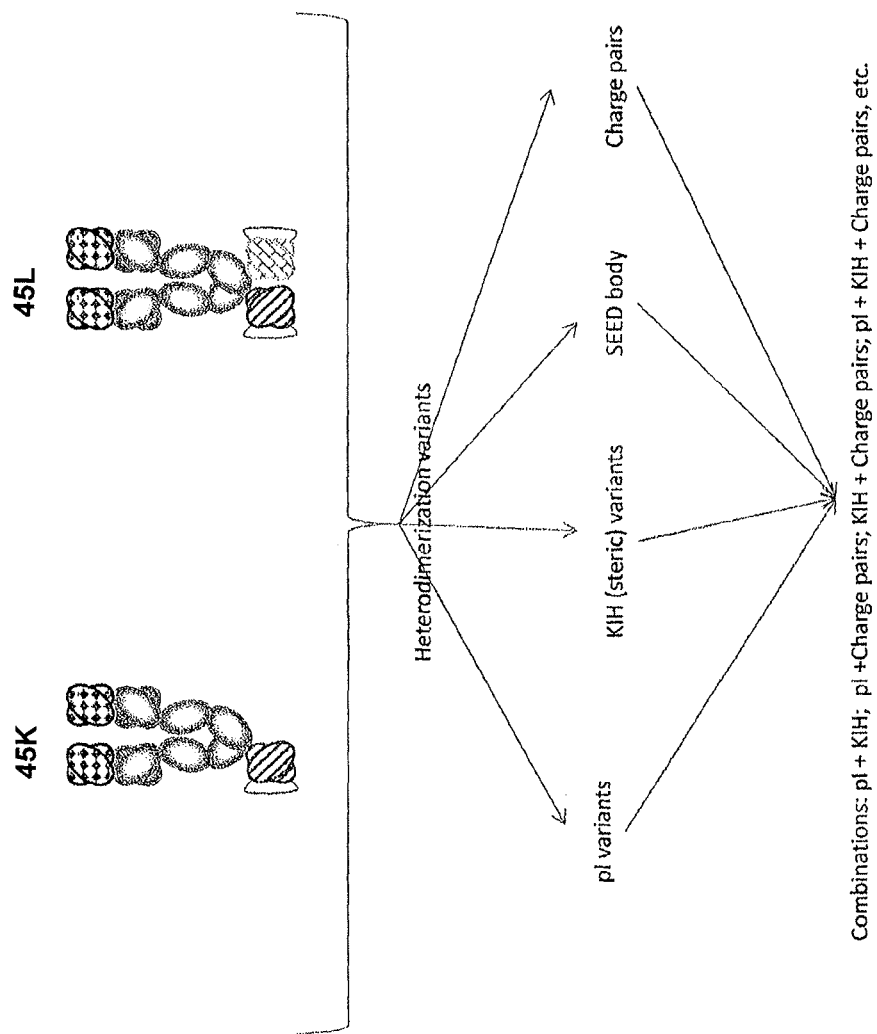
FIG. 45K depicts a mAb-scFv, wherein one end of the molecule engages an antigen bivalently with a monovalent engagement using an scFv on one of the heavy chains.
FIG. 45L depicts the same structure except that both heavy chains comprise an additional scFv, which can either bind the same antigen or different antigens.
Figure 45M:
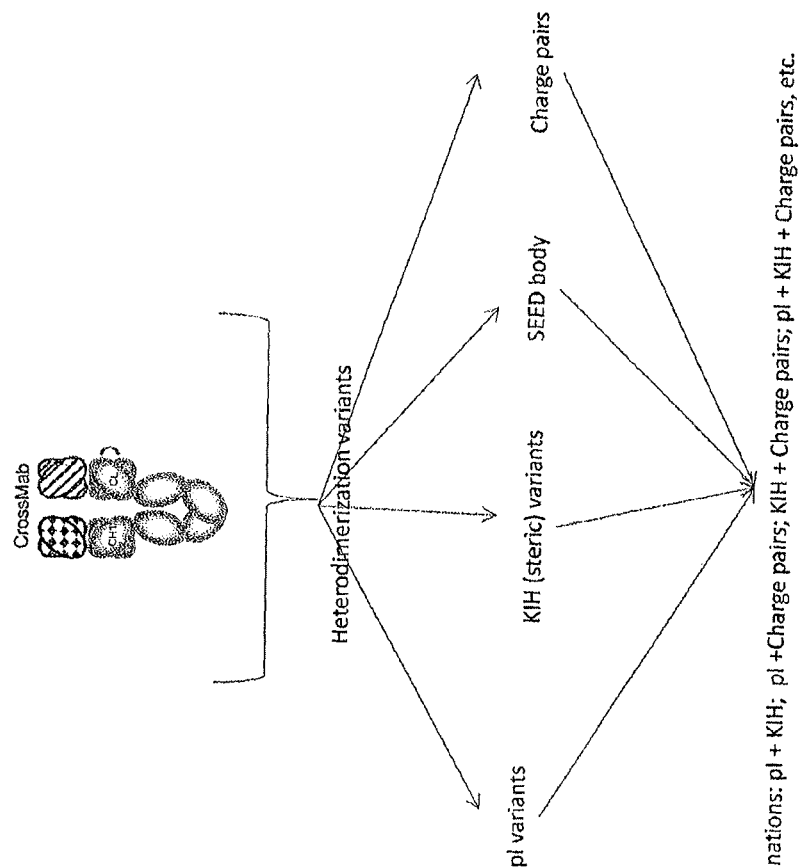
FIG. 45M shows the "CrossMab" structure, where the problem of multiplex formation due to two different light chains is addressed by switching sequences in the Fab portion.
Figures 45, 45N, 46, 47, 48, 49, 49R:
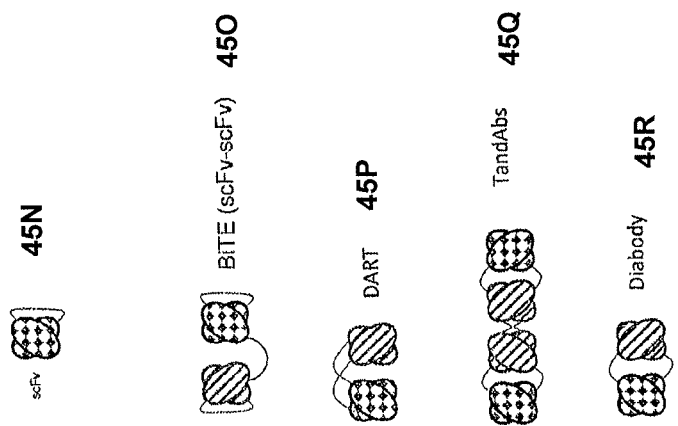
FIG. 45N depicts an scFv.
FIG. 48 shows binding affinities in a Biacore assay.
FIG. 49 shows the Heterodimer purity during stable pool generation using varied Light chain, Fab-Fc, and scFv-Fc ratios.
Figures 45S, 45T, 45U:
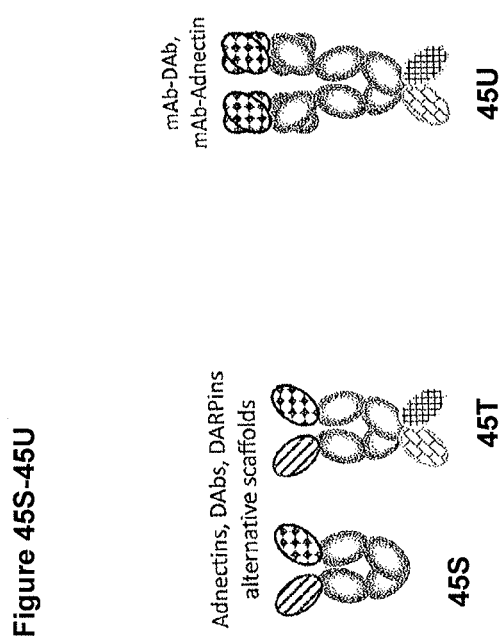

In addition, the present invention provides antigen binding domains of differing affinities. That is, in some indications, stronger affinities may be preferred, while in others, lesser affinities can find use, for both anti-CD3 and anti-CD38 sequences. Accordingly, in some embodiments the present invention provides antibody constructs comprising anti-CD3 antigen binding domains that are "strong" or "high affinity" binders to CD3 (e.g. one example are heavy and light variable domains depicted as H1.30_L1.47 (optionally including a charged linker as appropriate)). In other embodiments, the present invention provides antibody constructs comprising anti-CD3 antigen binding domains that are "lite" or "lower affinity" binders to CD3, as shown in FIG. 47.

II. Definitions

In order that the application may be more completely understood, several definitions are set forth below. Such definitions are meant to encompass grammatical equivalents.

By "ablation" herein is meant a decrease or removal of activity. Thus for example, "ablating FcγR binding" means the Fc region amino acid variant has less than 50% starting binding as compared to an Fc region not containing the specific variant, with less than 70-80-90-95-98% loss of activity being preferred, and in general, with the activity being below the level of detectable binding in a Biacore assay. Variants of particular use when ablation variants (also sometimes referred to herein as "FcγR ablation variants", "Fc ablation variants", "Fc knock outs" ("FcKO") or "knock out" ("KO") variants) are used are those depicted in FIG. 35.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity.

By "ADCP" or antibody dependent cell-mediated phagocytosis as used herein is meant the cell-mediated reaction wherein nonspecific cytotoxic cells that express FcγRs recognize bound antibody on a target cell and subsequently cause phagocytosis of the target cell.

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g. the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, -233E or 233E designates an insertion of glutamic acid after position 233 and before position 234. Additionally, -233ADE or A233ADE designates an insertion of AlaAsp-Glu after position 233 and before position 234.

By "amino acid deletion" or "deletion" as used herein is meant the removal of an amino acid sequence at a particular position in a parent polypeptide sequence. For example, G236- or G236# or G236del designates a deletion of glycine at position 236. Additionally, EDA233- or EDA233# designates a deletion of the sequence GluAspAla that begins at position 233. Similarly, some of the heterodimerization variants include "K447del", meaning the lysine at position 447 has been deleted.

By "variant protein" or "protein variant", or "variant" as used herein is meant a protein that differs from that of a parent protein by virtue of at least one amino acid modification. Protein variant may refer to the protein itself, a composition comprising the protein, or the amino sequence that encodes it. Preferably, the protein variant has at least one amino acid modification compared to the parent protein, e.g. from about one to about seventy amino acid modifications, and preferably from about one to about five amino acid modifications compared to the parent. As described below, in some embodiments the parent polypeptide, for example an Fc parent polypeptide, is a human wild type sequence, such as the Fc region from IgG1, IgG2, IgG3 or IgG4, although human sequences with variants can also serve as "parent polypeptides". The protein variant sequence herein will preferably possess at least about 80% identity with a parent protein sequence, and most preferably at least about 90% identity, more preferably at least about 95-98-99% identity. Variant protein can refer to the variant protein itself, compositions comprising the protein variant, or the DNA sequence that encodes it. Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein is meant an immunoglobulin sequence that differs from that of a parent immunoglobulin sequence by virtue of at least one amino acid modification. "Fc variant" or "variant Fc" as used herein is meant a protein comprising an amino acid modification in an Fc domain. The Fc variants of the present invention are defined according to the amino acid modifications that compose them. Thus, for example, N434S or 434S is an Fc variant with the substitution serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, 428L/434S is the same Fc variant as M428L/N434S, and so on. For all positions discussed in the present invention that relate to antibodies, unless otherwise noted, amino acid position numbering is according to the EU index. The EU index or EU index as in Kabat or EU numbering scheme refers to the numbering of the EU antibody (Edelman et al., 1969, Proc Natl Acad Sci USA 63:78-85, hereby entirely incorporated by reference.) The modification can be an addition, deletion, or substitution. Substitutions can include naturally occurring amino acids and, in some cases, synthetic amino acids. Examples include U.S. Pat. No. 6,586,207; WO 98/48032; WO 03/073238; US2004-0214988A1; WO 05/35727A2; WO 05/74524A2; J. W. Chin et al., (2002), Journal of the American Chemical Society 124:9026-9027; J. W. Chin, & P. G. Schultz, (2002), ChemBioChem 11:1135-1137; J. W. Chin, et al., (2002), PICAS United States of America 99:11020-11024; and, L. Wang, & P. G. Schultz, (2002), Chem. 1-10, all entirely incorporated by reference.

As used herein, "protein" herein is meant at least two covalently attached amino acids, which includes proteins, polypeptides, oligopeptides and peptides. The peptidyl group may comprise naturally occurring amino acids and peptide bonds, or synthetic peptidomimetic structures, i.e. "analogs", such as peptoids (see Simon et al., PNAS USA 89(20):9367 (1992), entirely incorporated by reference). The amino acids may either be naturally occurring or synthetic (e.g. not an amino acid that is coded for by DNA); as will be appreciated by those in the art. For example, homophenylalanine, citrulline, ornithine and noreleucine are considered synthetic amino acids for the purposes of the invention, and both D- and L-(R or S) configured amino acids may be utilized. The variants of the present invention may comprise modifications that include the use of synthetic amino acids incorporated using, for example, the technologies developed by Schultz and colleagues, including but not limited to methods described by Cropp & Shultz, 2004, Trends Genet. 20(12):625-30, Anderson et al., 2004, Proc Natl Acad Sci USA 101 (2):7566-71, Zhang et al., 2003, 303(5656):371-3, and Chin et al., 2003, Science 301(5635): 964-7, all entirely incorporated by reference. In addition, polypeptides may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Asparagine 297 (also referred to as Asn297 or N297) is a residue at position 297 in the human antibody IgG1.

By "Fab" or "Fab region" as used herein is meant the polypeptide that comprises the VH, CH1, VL, and CL immunoglobulin domains. Fab may refer to this region in isolation, or this region in the context of a full length antibody, antibody fragment or Fab fusion protein. By "Fv" or "Fv fragment" or "Fv region" as used herein is meant a polypeptide that comprises the VL and VH domains of a single antibody.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the IgGs comprise a serine at position 434, the substitution 434S in IgG1, IgG2, IgG3, or IgG4 (or hybrids thereof) is considered a non-naturally occurring modification. "Isotypic" modifications refer to the importation of one isotype amino acid at a position into the backbone of a different isotype; for example, the importation of an IgG1 amino acid into an IgG2 backbone at the same position.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. By "Fc ligand" as used herein is meant a molecule, preferably a polypeptide, from any organism that binds to the Fc region of an antibody to form an Fc/Fc ligand complex.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD 16), and FcγRIII-2 (CD16-2), as well as any undiscovered mouse FcγRs or FcγR isoforms or allotypes.

By "FcRn" or "neonatal Fc Receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants used to increase binding to the FcRn receptor, and in some cases, to increase serum half-life. Fc variants conferring increased binding to the FcRn receptor and corresponding increases in serum half life include, but are not limited to, 434A, 434S, 428L, 308F, 259I, 428L/434S, 259I/308F, 436I/428L, 436I or V/434S, 436V/428L, 252Y, 252Y/254T/256E and 259I/308F/428L. That is, the Triple F format of FIG. 8B can have any of these FcRn variants on either or both monomer sequences. For clarity, as each heavy chain is different, FcRn variants (as well as the Fc variants) can reside on one or both monomers.

By "parent polypeptide" as used herein is meant a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it. Accordingly, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below.

By "Fc fusion protein" or "immunoadhesin" herein is meant a protein comprising an Fc region, generally linked (optionally through a linker moiety, as described herein) to a different protein, such as a binding moiety to a target protein, as described herein).

By "position" as used herein is meant a location in the sequence of a protein. Positions may be numbered sequentially, or according to an established format, for example the EU index for antibody numbering.

By "strandedness" in the context of the monomers of the heterodimeric proteins of the invention herein is meant that, similar to the two strands of DNA that "match", heterodimerization variants are incorporated into each monomer so as to preserve the ability to "match" to form heterodimers. For example, if some pI variants are engineered into monomer A (e.g. making the pI higher) then steric variants that are "charge pairs" that can be utilized as well do not interfere with the pI variants, e.g. the charge variants that make a pI higher are put on the same "strand" or "monomer" to preserve both functionalities.

By "target antigen" as used herein is meant the molecule that is bound specifically by the variable region of a given antibody. A target antigen may be a protein, carbohydrate, lipid, or other chemical compound. Preferred target antigens of the present invention are CD3 and CD38.

By "target cell" as used herein is meant a cell that expresses a target antigen.

By "variable region" as used herein is meant the region of an immunoglobulin that comprises one or more Ig domains substantially encoded by any of the V.kappa., V.lamda., and/or VH genes that make up the kappa, lambda, and heavy chain immunoglobulin genetic loci respectively.

By "wild type or WT" herein is meant an amino acid sequence or a nucleotide sequence that is found in nature, including allelic variations. A WT protein has an amino acid sequence or a nucleotide sequence that has not been intentionally modified.

By "single chain variable fragment", "scFv" or "single chain Fv" as is well understood in the art, herein is meant a fusion protein of the variable heavy and light chains of an antibody, usually linked with a linker peptide. Typical scFv linkers are well known in the art, are generally 10 to 25 amino acids in length and include glycines and serines.

By "charged scFv linker" herein is meant a scFv linker that utilizes charged amino acids for use in the creation and purification of heterodimeric antibodies that include at least one scFv. Suitable charged scFv linkers are shown in Figure, although others can be used. In general, the charged scFv linkers for use in the present invention have a charge change from 3 to 8 (3, 4, 5, 6, 7 or 8 all being possible) as compared to the standard uncharged scFv linkers such as $(GGGGS)_{3-5}$ (SEQ ID NO:429) sequences traditionally used (either negative or positive). As will be appreciated by those in the art, heterodimeric antibodies that utilize two scFvs can have one charged and one neutral linker (e.g. either a positively or negatively charged scFv linker) or two oppositely charged scFv linkers (one positive and one negative).

Heterodimeric Proteins

The present invention is directed to the generation of multispecific, particularly bispecific binding proteins, and in particular, multispecific antibodies that have one monomer comprising an scFv and the other an Fv. As discussed herein, many of the disclosed embodiments use an scFv that binds CD3 and the Fv (or Fab) that binds CD38. Alternatively, the vh and vl anti-CD38 sequences herein can be used in scFv constructs, where the anti-CD3 monomer is a Fab.

Antibodies

The present invention relates to the generation of multispecific antibodies, generally therapeutic antibodies. As is discussed below, the term "antibody" is used generally. Antibodies that find use in the present invention can take on a number of formats as described herein, including traditional antibodies as well as antibody derivatives, fragments and mimetics, described below. In general, the term "antibody" includes any polypeptide that includes at least one constant domain, including, but not limited to, CH1, CH2, CH3 and CL. Particularly preferred antibodies herein are the "triple F" format antibodies.

Traditional antibody structural units typically comprise a tetramer. Each tetramer is typically composed of two identical pairs of polypeptide chains, each pair having one "light" (typically having a molecular weight of about 25 kDa) and one "heavy" chain (typically having a molecular weight of about 50-70 kDa). Human light chains are classified as kappa and lambda light chains. The present invention is directed to the IgG class, which has several subclasses, including, but not limited to IgG1, IgG2, IgG3, and IgG4. Thus, "isotype" as used herein is meant any of the subclasses of immunoglobulins defined by the chemical and antigenic characteristics of their constant regions. It should be understood that therapeutic antibodies can also comprise hybrids of isotypes and/or subclasses. For example, as shown in US Publication 2009/0163699, incorporated by reference, the present invention covers pI engineering of IgG1/G2 hybrids.

The amino-terminal portion of each chain includes a variable region of about 100 to 110 or more amino acids primarily responsible for antigen recognition, generally referred to in the art and herein as the "Fv domain" or "Fv region". In the variable region, three loops are gathered for each of the V domains of the heavy chain and light chain to form an antigen-binding site. Each of the loops is referred to as a complementarity-determining region (hereinafter referred to as a "CDR"), in which the variation in the amino acid sequence is most significant. "Variable" refers to the fact that certain segments of the variable region differ extensively in sequence among antibodies. Variability within the variable region is not evenly distributed. Instead, the V regions consist of relatively invariant stretches called framework regions (FRs) of 15-30 amino acids separated by shorter regions of extreme variability called "hypervariable regions" that are each 9-15 amino acids long or longer.

Each VH and VL is composed of three hypervariable regions ("complementary determining regions," "CDRs") and four FRs, arranged from amino-terminus to carboxy-terminus in the following order: FRI-CDR1-FR2-CDR2-FR3-CDR3-FR4.

The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below.

Throughout the present specification, the Kabat numbering system is generally used when referring to a residue in the variable domain (approximately, residues 1-107 of the light chain variable region and residues 1-113 of the heavy chain variable region) (e.g, Kabat et al., supra (1991)).

The CDRs contribute to the formation of the antigen-binding, or more specifically, epitope binding site of antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning."

The carboxy-terminal portion of each chain defines a constant region primarily responsible for effector function. Kabat et al. collected numerous primary sequences of the variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference).

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-220 according to the EU index as in Kabat. "CH2" refers to positions 237-340 according to the EU index as in Kabat, and "CH3" refers to positions 341-447 according to the EU index as in Kabat. As shown herein and described below, the pI variants can be in one or more of the CH regions, as well as the hinge region, discussed below.

It should be noted that the sequences depicted herein start at the CH1 region, position 118; the variable regions are not included except as noted. For example, the first amino acid of SEQ ID NO: 2, while designated as position "1" in the sequence listing, corresponds to position 118 of the CH1 region, according to EU numbering.

Another type of Ig domain of the heavy chain is the hinge region. By "hinge" or "hinge region" or "antibody hinge region" or "immunoglobulin hinge region" herein is meant the flexible polypeptide comprising the amino acids between the first and second constant domains of an antibody. Structurally, the IgG CH1 domain ends at EU position 220, and the IgG CH2 domain begins at residue EU position 237. Thus for IgG the antibody hinge is herein defined to include positions 221 (D221 in IgG1) to 236 (G236 in IgG1), wherein the numbering is according to the EU index as in Kabat. In some embodiments, for example in the context of an Fc region, the lower hinge is included, with the "lower hinge" generally referring to positions 226 or 230. As noted herein, pI variants can be made in the hinge region as well.

The light chain generally comprises two domains, the variable light domain (containing the light chain CDRs and together with the variable heavy domains forming the Fv region), and a constant light chain region (often referred to as CL or CK).

Another region of interest for additional substitutions, outlined below, is the Fc region. By "Fc" or "Fc region" or "Fc domain" as used herein is meant the polypeptide comprising the constant region of an antibody excluding the first constant region immunoglobulin domain and in some cases, part of the hinge. Thus Fc refers to the last two constant region immunoglobulin domains of IgA, IgD, and IgG, the last three constant region immunoglobulin domains of IgE and IgM, and the flexible hinge N-terminal to these domains. For IgA and IgM, Fc may include the J chain. For IgG, the Fc domain comprises immunoglobulin domains Cγ2 and Cγ3 (Cγ2 and Cγ3) and the lower hinge region between Cγ1 (Cγ1) and Cγ2 (Cγ2). Although the boundaries of the Fc region may vary, the human IgG heavy chain Fc region is usually defined to include residues C226 or P230 to its carboxyl-terminus, wherein the numbering is according to the EU index as in Kabat. In some embodiments, as is more fully described below, amino acid modifications are made to the Fc region, for example to alter binding to one or more FcγR receptors or to the FcRn receptor.

In some embodiments, the antibodies are full length. By "full length antibody" herein is meant the structure that constitutes the natural biological form of an antibody, including variable and constant regions, including one or more modifications as outlined herein.

Alternatively, the antibodies can include a variety of structures, including, but not limited to, antibody fragments, monoclonal antibodies, bispecific antibodies, minibodies, domain antibodies, synthetic antibodies (sometimes referred to herein as "antibody mimetics"), chimeric antibodies, humanized antibodies, antibody fusions (sometimes referred to as "antibody conjugates"), and fragments of each, respectively.

In one embodiment, the antibody is an antibody fragment, as long as it contains at least one constant domain which can be engineered to produce heterodimers, such as pI engineering. Other antibody fragments that can be used include fragments that contain one or more of the CH1, CH2, CH3, hinge and CL domains of the invention that have been pI engineered. For example, Fc fusions are fusions of the Fc region (CH2 and CH3, optionally with the hinge region) fused to another protein. A number of Fc fusions are known the art and can be improved by the addition of the heterodimerization variants of the invention. In the present case, antibody fusions can be made comprising CH1; CH1, CH2 and CH3; CH2; CH3; CH2 and CH3; CH1 and CH3, any or all of which can be made optionally with the hinge region, utilizing any combination of heterodimerization variants described herein.

In some embodiments of the present invention, one monomer comprises a heavy chain comprises a scFV linked to an Fc domain, and the other monomer comprises a heavy chain comprising a Fab linked to an Fc domain, e.g. a "typical" heavy chain, and a light chain. By "Fab" or "Fab region" as used herein is meant the polypeptide that comprises the VH, CH1, VL, and CL immunoglobulin domains. Fab may refer to this region in isolation, or this region in the context of a full length antibody, antibody fragment or Fab fusion protein. By "Fv" or "Fv fragment" or "Fv region" as used herein is meant a polypeptide that comprises the VL and VH domains of a single antibody.

Chimeric and Humanized Antibodies

In some embodiments, the antibody can be a mixture from different species, e.g. a chimeric antibody and/or a humanized antibody. In general, both "chimeric antibodies" and "humanized antibodies" refer to antibodies that combine regions from more than one species. For example, "chimeric antibodies" traditionally comprise variable region(s) from a mouse (or rat, in some cases) and the constant region(s) from a human. "Humanized antibodies" generally refer to non-human antibodies that have had the variable-domain framework regions swapped for sequences found in human antibodies. Generally, in a humanized antibody, the entire antibody, except the CDRs, is encoded by a polynucleotide of human origin or is identical to such an antibody except within its CDRs. The CDRs, some or all of which are encoded by nucleic acids originating in a non-human organism, are grafted into the beta-sheet framework of a human antibody variable region to create an antibody, the specificity of which is determined by the engrafted CDRs. The creation of such antibodies is described in, e.g., WO 92/11018, Jones, 1986, Nature 321:522-525, Verhoeyen et al., 1988, Science 239:1534-1536, all entirely incorporated by reference. "Backmutation" of selected acceptor framework residues to the corresponding donor residues is often required to regain affinity that is lost in the initial grafted construct (U.S. Pat. Nos. 5,530,101; 5,585,089; 5,693,761; 5,693,762; 6,180,370; 5,859,205; 5,821,337; 6,054,297; 6,407,213, all entirely incorporated by reference). The humanized antibody optimally also will comprise at least a portion of an immunoglobulin constant region, typically that of a human immunoglobulin, and thus will typically comprise a human Fc region. Humanized antibodies can also be generated using mice with a genetically engineered immune system. Roque et al., 2004, Biotechnol. Prog. 20:639-654, entirely incorporated by reference. A variety of techniques and methods for humanizing and reshaping non-human antibodies are well known in the art (See Tsurushita & Vasquez, 2004, Humanization of Monoclonal Antibodies, Molecular Biology of B Cells, 533-545, Elsevier Science (USA), and references cited therein, all entirely incorporated by reference). Humanization methods include but are not limited to methods described in Jones et al., 1986, Nature 321:522-525; Riechmann et al., 1988; Nature 332:323-329; Verhoeyen et al., 1988, Science, 239:1534-1536; Queen et al., 1989, Proc Natl Acad Sci, USA 86:10029-33; He et al., 1998, J. Immunol. 160: 1029-1035; Carter et al., 1992, Proc Natl Acad Sci USA 89:4285-9, Presta et al., 1997, Cancer Res. 57(20):4593-9; Gorman et al., 1991, Proc. Natl. Acad. Sci. USA 88:4181-4185; O'Connor et al., 1998, Protein Eng 11:321-8, all entirely incorporated by reference. Humanization or other methods of reducing the immunogenicity of nonhuman antibody variable regions may include resurfacing methods, as described for example in Roguska et al., 1994, Proc. Natl. Acad. Sci. USA 91:969-973, entirely incorporated by reference. In one embodiment, the parent antibody has been affinity matured, as is known in the art. Structure-based methods may be employed for humanization and affinity maturation, for example as described in U.S. Ser. No. 11/004,590. Selection based methods may be employed to humanize and/or affinity mature antibody variable regions, including but not limited to methods described in Wu et al., 1999, J. Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

Multispecific Antibody Constructs

As will be appreciated by those in the art and discussed more fully below, the heterodimeric fusion proteins of the present invention take on a number variety of configurations, with a preferred embodiment shown in Figure B as a "triple F" construct.

Heterodimeric Heavy Chain Constant Regions

Accordingly, the present invention provides heterodimeric proteins based on the use of monomers containing variant heavy chain constant regions as a first domain. By "monomer" herein is meant one half of the heterodimeric protein. It should be noted that traditional antibodies are actually tetrameric (two heavy chains and two light chains). In the context of the present invention, one pair of heavy-light chains (if applicable, e.g. if the monomer comprises an Fab) is considered a "monomer". Similarly, a heavy chain region comprising the scFv is considered a monomer. Essentially, each monomer comprises sufficient heavy chain constant region to allow heterodimerization engineering, whether that be all the constant region, e.g. Ch1-hinge-CH2-CH3, the Fc region (CH2-CH3), or just the CH3 domain.

The variant heavy chain constant regions can comprise all or part of the heavy chain constant region, including the full length construct, CH1-hinge-CH2-CH3, or portions thereof, including for example CH2-CH3 or CH3 alone. In addition, the heavy chain region of each monomer can be the same backbone (CH1-hinge-CH2-CH3 or CH2-CH3) or different. N- and C-terminal truncations and additions are also included within the definition; for example, some pI variants include the addition of charged amino acids to the C-terminus of the heavy chain domain.

Thus, in general, one monomer of the present "triple F" construct is a scFv region-hinge-Fc domain) and the other is (VH-CH1-hinge-CH2-CH3 plus associated light chain), with heterodimerization variants, including steric and pI variants, Fc and FcRn variants, and additional antigen binding domains (with optional linkers) included in these regions.

In addition to the heterodimerization variants (e.g. steric and pI variants) outlined herein, the heavy chain regions may also contain additional amino acid substitutions, including changes for altering FcγR and FcRn binding as discussed below.

In addition, some monomers can utilize linkers for the scFv portion of the "bottle-opener". In the Triple F format, one charged scFv linker is used. As noted herein, depending on the inherent pI of the scFv for the target antigen and the inherent pI of the Fab of the other target antigen, the charged scFv linker can either be positive or negative. In dual scFv formats, either a single charged scFv linker is used on one monomer (again, either positive or negative) or both (one positive and one negative). In this embodiment, the charge of each of the two linkers need not be the same (e.g. +3 for one and −4 for the other, etc.).

In one embodiment, it is the anti-CD3 antigen binding site that is the scFv, and includes a positively charged scFv linker. Alternatively, it can be the anti-CD38 antigen binding site that is the scFv of the "bottle opener" construct.

The heterodimerization variants include a number of different types of variants, including, but not limited to, steric variants (including charge variants) and pI variants, that can be optionally and independently combined with any other variants. In these embodiments, it is important to match "monomer A" with "monomer B"; that is, if a heterodimeric protein relies on both steric variants and pI variants, these need to be correctly matched to each monomer: e.g. the set of steric variants that work (1 set on monomer A, 1 set on monomer B) is combined with pI variant sets (1 set on monomer A, 1 set on monomer B), such that the variants on each monomer are designed to achieve the desired function. In the case for example where steric variants may also change the charge, the correct sets have to be matched to the correct monomer.

It is important to note that the heterodimerization variants outlined herein (for example, including but not limited to those variants shown in the Figures), can be optionally and independently combined with any other variants, and on any other monomer. Thus, for example, pI variants for monomer 1 from one figure can be added to other heterodimerization variants for monomer 1 in a different figure or from monomer 2. That is, what is important for the heterodimerization is that there are "sets" of variants, one set for one monomer and one set for the other. Whether these are combined from the FIGS. 1 to 1 (e.g. monomer 1 listings can go together) or switched (monomer 1 pI variants with monomer 2 steric variants) is irrelevant. However, as noted herein, "strandedness" should be preserved when combinations are made as outlined above such that heterodimerization is favored; e.g. charge variants that increase pI should be used with increased pI variants and/or an scFv linker with increase pI, etc. Furthermore, for the additional Fc variants (such as for FcγR binding, FcRn binding, ablation variants etc.), either monomer, or both monomers, can include any of the listed variants, independently and optionally. In some cases, both monomers have the additional variants and in some only one monomer has the additional variants, or they can be combined.

Heterodimerization Variants

The present invention provides multispecific antibody formats, on a "triple F" or "bottle opener" scaffold as depicted in FIG. 8B, for example.

Steric Variants

In some embodiments, the formation of heterodimers can be facilitated by the addition of steric variants. That is, by changing amino acids in each heavy chain, different heavy chains are more likely to associate to form the heterodimeric structure than to form homodimers with the same Fc amino acid sequences. Suitable steric variants are shown in the Figures One mechanism is generally referred to in the art as "knobs and holes", referring to amino acid engineering that creates steric influences to favor heterodimeric formation and disfavor homodimeric formation can also optionally be used; this is sometimes referred to as "knobs and holes", as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. FIGS. 4 and 5, further described below, identifies a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "steric variants". These include, but are not limited to, variants resulting in greater than 75% heterodimerization in the Figures such as D221E/P228E/L368E paired with D221R/P228R/K409R (e.g. these are "monomer corresponding sets) and C220E/P228E/368E paired with C220R/E224R/P228R/K409R.

Figure 37:
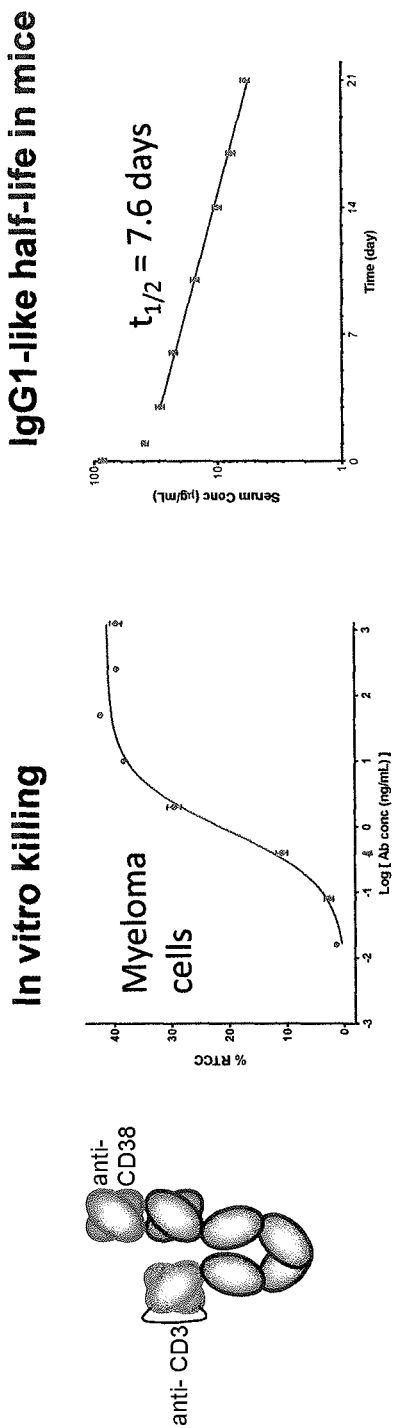
FIG. 37 depicts the in vitro killing and stability data for an anti-CD3×anti-CD38 bottle opener format.

Additional monomer A and monomer B variants that can be combined with other variants, optionally and independently in any amount, such as pI variants outlined herein or other steric variants that are shown in FIG. 37 of US 2012/0149876, the figure and legend of which are incorporated expressly by reference herein.

In some embodiments, the steric variants outlined herein can be optionally and independently incorporated with any heterodimerization variants including pI variants (or other variants such as Fc variants, FcRn variants, ablation variants, etc.) into one or both monomers.

pI (Isoelectric Point) Variants for Heterodimers

In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

Preferred combinations of pI variants are shown in the Figures.

Heavy Chain Acidic pI Changes

Accordingly, when one monomer comprising a variant heavy chain constant domain is to be made more positive (e.g. lower the pI), one or more of the following substitutions can be made: S119E, K133E, K133Q, T164E, K205E, K205Q, N208D, K210E, K210Q, K274E, K320E, K322E, K326E, K334E, R355E, K392E, a deletion of K447, adding peptide DEDE at the c-terminus, G137E, N203D, K274Q, R355Q, K392N and Q419E. As outlined herein and shown in the figures, these changes are shown relative to IgG1, but all isotypes can be altered this way, as well as isotype hybrids.

In the case where the heavy chain constant domain is from IgG2-4, R133E and R133Q can also be used.

Basic pI Changes

Accordingly, when one monomer comprising a variant heavy chain constant domain is to be made more negative (e.g. increase the pI), one or more of the following substitutions can be made: Q196K, P217R, P228R, N276K and H435R. As outlined herein and shown in the figures, these changes are shown relative to IgG1, but all isotypes can be altered this way, as well as isotype hybrids.

Antibody Heterodimers Light Chain Variants

In the case of antibody based heterodimers, e.g. where at least one of the monomers comprises a light chain in addition to the heavy chain domain, pI variants can also be made in the light chain. Amino acid substitutions for lowering the pI of the light chain include, but are not limited to, K126E, K126Q, K145E, K145Q, N152D, S156E, K169E, S202E, K207E and adding peptide DEDE at the c-terminus of the light chain. Changes in this category based on the constant lambda light chain include one or more substitutions at R108Q, Q124E, K126Q, N138D, K145T and Q199E. In addition, increasing the pI of the light chains can also be done.

Isotypic Variants

In addition, many embodiments of the invention rely on the "importation" of pI amino acids at particular positions from one IgG isotype into another, thus reducing or eliminating the possibility of unwanted immunogenicity being introduced into the variants. That is, IgG1 is a common isotype for therapeutic antibodies for a variety of reasons, including high effector function. However, the heavy constant region of IgG 1 has a higher pI than that of IgG2 (8.10 versus 7.31). By introducing IgG2 residues at particular positions into the IgG backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant antibody. However, it should be noted as discussed below that even changes in IgG2 molecules allow for increased serum half-life.

In other embodiments, non-isotypic amino acid changes are made, either to reduce the overall charge state of the resulting protein (e.g. by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

Isosteric Variants

In addition, as shown in FIG. 47, pI variants that are isosteric, e.g. charge variants that are roughly the same size as the parent amino acid can be made.

Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the Figures. Alternatively, the pI of each monomer can be compared. Similarly, the pIs of the "starting" variable regions (e.g. either scFv or Fab) are calculated to inform which monomer will be engineered in which direction.

pI Variants that Also Confer Better FcRn In Vivo Binding

In the case where the pI variant decreases the pI of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall' Acqua et al. showed that Fc mutants with increased FcRn binding at pH 6 and pH 7.4 actually had reduced serum concentrations and the same half life as wild-type Fc (Dall' Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

Recently it has been suggested that antibodies with variable regions that have lower isoelectric points may also have longer serum half-lives (Igawa et al., 2010 PEDS. 23(5): 385-392, entirely incorporated by reference). However, the mechanism of this is still poorly understood. Moreover, variable regions differ from antibody to antibody. Constant region variants with reduced pI and extended half-life would provide a more modular approach to improving the pharmacokinetic properties of antibodies, as described herein.

pI variants that find use in this embodiment, as well as their use for purification optimization, are disclosed in the Figures.

Combination of Variants

As will be appreciated by those in the art, all of the recited heterodimerization variants can be optionally and independently combined in any way, as long as they retain their "strandedness" or "monomer partition". In addition, all of these variants can be combined into any of the heterodimerization formats.

In the case of pI variants, while embodiments finding particular use are shown in the Figures, other combinations can be generated, following the basic rule of altering the pI difference between two monomers to facilitate purification.

The antibodies of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated antibody," refers to an antibody which is substantially free of other antibodies having different antigenic specificities.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about 10-4 M, at least about 10-5 M, at least about 10-6 M, at least about 10-7 M, at least about 10-8 M, at least about 10-9 M, alternatively at least about 10-10 M, at least about 10-11 M, at least about 10-12 M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction.

Modified Antibodies

In addition to the modifications outlined above, other modifications can be made. For example, the molecules may be stabilized by the incorporation of disulphide bridges linking the VH and VL domains (Reiter et al., 1996, Nature Biotech. 14:1239-1245, entirely incorporated by reference). In addition, there are a variety of covalent modifications of antibodies that can be made as outlined below.

Covalent modifications of antibodies are included within the scope of this invention, and are generally, but not always, done post-translationally. For example, several types of covalent modifications of the antibody are introduced into the molecule by reacting specific amino acid residues of the antibody with an organic derivatizing agent that is capable of reacting with selected side chains or the N- or C-terminal residues.

Cysteinyl residues most commonly are reacted with α-haloacetates (and corresponding amines), such as chloroacetic acid or chloroacetamide, to give carboxymethyl or carboxyamidomethyl derivatives. Cysteinyl residues may also be derivatized by reaction with bromotrifluoroacetone, α-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole and the like.

In addition, modifications at cysteines are particularly useful in antibody-drug conjugate (ADC) applications, further described below. In some embodiments, the constant region of the antibodies can be engineered to contain one or more cysteines that are particularly "thiol reactive", so as to allow more specific and controlled placement of the drug moiety. See for example U.S. Pat. No. 7,521,541, incorporated by reference in its entirety herein.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1M sodium cacodylate at pH 6.0.

Lysinyl and amino terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4-pentanedione; and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively. Tyrosyl residues are iodinated using 125I or 131I to prepare labeled proteins for use in radioimmunoassay, the chloramine T method described above being suitable.

Carboxyl side groups (aspartyl or glutamyl) are selectively modified by reaction with carbodiimides (R'—N=C=N—R'), where R and R' are optionally different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Derivatization with bifunctional agents is useful for crosslinking antibodies to a water-insoluble support matrix or surface for use in a variety of methods, in addition to methods described below. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis (succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cynomolgusogen bromide-activated carbohydrates and the reactive substrates described in U.S. Pat. Nos. 3,969,287; 3,691,016; 4,195,128; 4,247,642; 4,229,537; and 4,330,440, all entirely incorporated by reference, are employed for protein immobilization.

Glutaminyl and asparaginyl residues are frequently deamidated to the corresponding glutamyl and aspartyl residues, respectively. Alternatively, these residues are deamidated under mildly acidic conditions. Either form of these residues falls within the scope of this invention.

Other modifications include hydroxylation of proline and lysine, phosphorylation of hydroxyl groups of seryl or threonyl residues, methylation of the α-amino groups of lysine, arginine, and histidine side chains (T. E. Creighton, Proteins: Structure and Molecular Properties, W. H. Freeman & Co., San Francisco, pp. 79-86 [1983], entirely incorporated by reference), acetylation of the N-terminal amine, and amidation of any C-terminal carboxyl group.

In addition, as will be appreciated by those in the art, labels (including fluorescent, enzymatic, magnetic, radioactive, etc. can all be added to the antibodies (as well as the other compositions of the invention).

Glycosylation

Another type of covalent modification is alterations in glycosylation. In another embodiment, the antibodies disclosed herein can be modified to include one or more engineered glycoforms. By "engineered glycoform" as used herein is meant a carbohydrate composition that is covalently attached to the antibody, wherein said carbohydrate composition differs chemically from that of a parent antibody. Engineered glycoforms may be useful for a variety of purposes, including but not limited to enhancing or reducing effector function. A preferred form of engineered glycoform is afucosylation, which has been shown to be correlated to an increase in ADCC function, presumably through tighter binding to the FcγRIIIa receptor. In this context, "afucosylation" means that the majority of the antibody produced in the host cells is substantially devoid of fucose, e.g. 90-95-98% of the generated antibodies do not have appreciable fucose as a component of the carbohydrate moiety of the antibody (generally attached at N297 in the Fc region). Defined functionally, afucosylated antibodies generally exhibit at least a 50% or higher affinity to the FcγRIIIa receptor.

Engineered glycoforms may be generated by a variety of methods known in the art (Umaña et al., 1999, Nat Biotechnol 17:176-180; Davies et al., 2001, Biotechnol Bioeng 74:288-294; Shields et al., 2002, J Biol Chem 277:26733-26740; Shinkawa et al., 2003, J Biol Chem 278:3466-3473; U.S. Pat. No. 6,602,684; U.S. Ser. No. 10/277,370; U.S. Ser. No. 10/113,929; PCT WO 00/61739A1; PCT WO 01/29246A1; PCT WO 02/31140A1; PCT WO 02/30954A1, all entirely incorporated by reference; (Potelligent® technology [Biowa, Inc., Princeton, N.J.]; GlycoMAb® glycosylation engineering technology [Glycart Biotechnology AG, Zürich, Switzerland]). Many of these techniques are based on controlling the level of fucosylated and/or bisecting oligosaccharides that are covalently attached to the Fc region, for example by expressing an IgG in various organisms or cell lines, engineered or otherwise (for example Lec-13 CHO cells or rat hybridoma YB2/0 cells, by regulating enzymes involved in the glycosylation pathway (for example FUT8 [α1,6-fucosyltranserase] and/or β1-4-N-acetylglucosaminyltransferase III [GnTIII]), or by modifying carbohydrate(s) after the IgG has been expressed. For example, the "sugar engineered antibody" or "SEA technology" of Seattle Genetics functions by adding modified saccharides that inhibit fucosylation during production; see for example 20090317869, hereby incorporated by reference in its entirety. Engineered glycoform typically refers to the different carbohydrate or oligosaccharide; thus an antibody can include an engineered glycoform.

Alternatively, engineered glycoform may refer to the IgG variant that comprises the different carbohydrate or oligosaccharide. As is known in the art, glycosylation patterns can depend on both the sequence of the protein (e.g., the presence or absence of particular glycosylation amino acid residues, discussed below), or the host cell or organism in which the protein is produced. Particular expression systems are discussed below.

Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

Addition of glycosylation sites to the antibody is conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the antibody amino acid sequence is preferably altered through changes at the DNA level, particularly by mutating the DNA encoding the target polypeptide at preselected bases such that codons are generated that will translate into the desired amino acids.

Another means of increasing the number of carbohydrate moieties on the antibody is by chemical or enzymatic coupling of glycosides to the protein. These procedures are advantageous in that they do not require production of the protein in a host cell that has glycosylation capabilities for N- and O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330 and in Aplin and Wriston, 1981, CRC Crit. Rev. Biochem., pp. 259-306, both entirely incorporated by reference.

Removal of carbohydrate moieties present on the starting antibody (e.g. post-translationally) may be accomplished chemically or enzymatically. Chemical deglycosylation requires exposure of the protein to the compound trifluoromethanesulfonic acid, or an equivalent compound. This treatment results in the cleavage of most or all sugars except the linking sugar (N-acetylglucosamine or N-acetylgalactosamine), while leaving the polypeptide intact. Chemical deglycosylation is described by Hakimuddin et al., 1987, Arch. Biochem. Biophys. 259:52 and by Edge et al., 1981, Anal. Biochem. 118:131, both entirely incorporated by reference. Enzymatic cleavage of carbohydrate moieties on polypeptides can be achieved by the use of a variety of endo- and exo-glycosidases as described by Thotakura et al., 1987, Meth. Enzymol. 138:350, entirely incorporated by reference. Glycosylation at potential glycosylation sites may be prevented by the use of the compound tunicamycin as described by Duskin et al., 1982, J. Biol. Chem. 257:3105, entirely incorporated by reference. Tunicamycin blocks the formation of protein-N-glycoside linkages.

Another type of covalent modification of the antibody comprises linking the antibody to various nonproteinaceous polymers, including, but not limited to, various polyols such as polyethylene glycol, polypropylene glycol or polyoxyalkylenes, in the manner set forth in, for example, 2005-2006 PEG Catalog from Nektar Therapeutics (available at the Nektar website) U.S. Pat. Nos. 4,640,835; 4,496,689; 4,301,144; 4,670,417; 4,791,192 or 4,179,337, all entirely incorporated by reference. In addition, as is known in the art, amino acid substitutions may be made in various positions within the antibody to facilitate the addition of polymers such as PEG. See for example, U.S. Publication No. 2005/0114037A1, entirely incorporated by reference.

Additional Fc Variants for Additional Functionality

In addition to pI amino acid variants, there are a number of useful Fc amino acid modification that can be made for a variety of reasons, including, but not limited to, altering binding to one or more FcγR receptors, altered binding to FcRn receptors, etc.

Accordingly, the proteins of the invention can include amino acid modifications, including the heterodimerization variants outlined herein, which includes the pI variants FcγR Variants Accordingly, there are a number of useful Fc substitutions that can be made to alter binding to one or more of the FcγR receptors. Substitutions that result in increased binding as well as decreased binding can be useful. For example, it is known that increased binding to Fc RIIIa generally results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41), Ser. Nos. 11/174,287, 11/396,495, 11/538,406, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L and 299T.

In addition, there are additional Fc substitutions that find use in increased binding to the FcRn receptor and increased serum half life, as specifically disclosed in U.S. Ser. No. 12/341,769, hereby incorporated by reference in its entirety, including, but not limited to, 434S, 428L, 308F, 259I, 428L/434S, 259I/308F, 436I/428L, 436I or V/434S, 436V/428L and 259I/308F/428L.

Fc Ablation Variants

Figure 35:
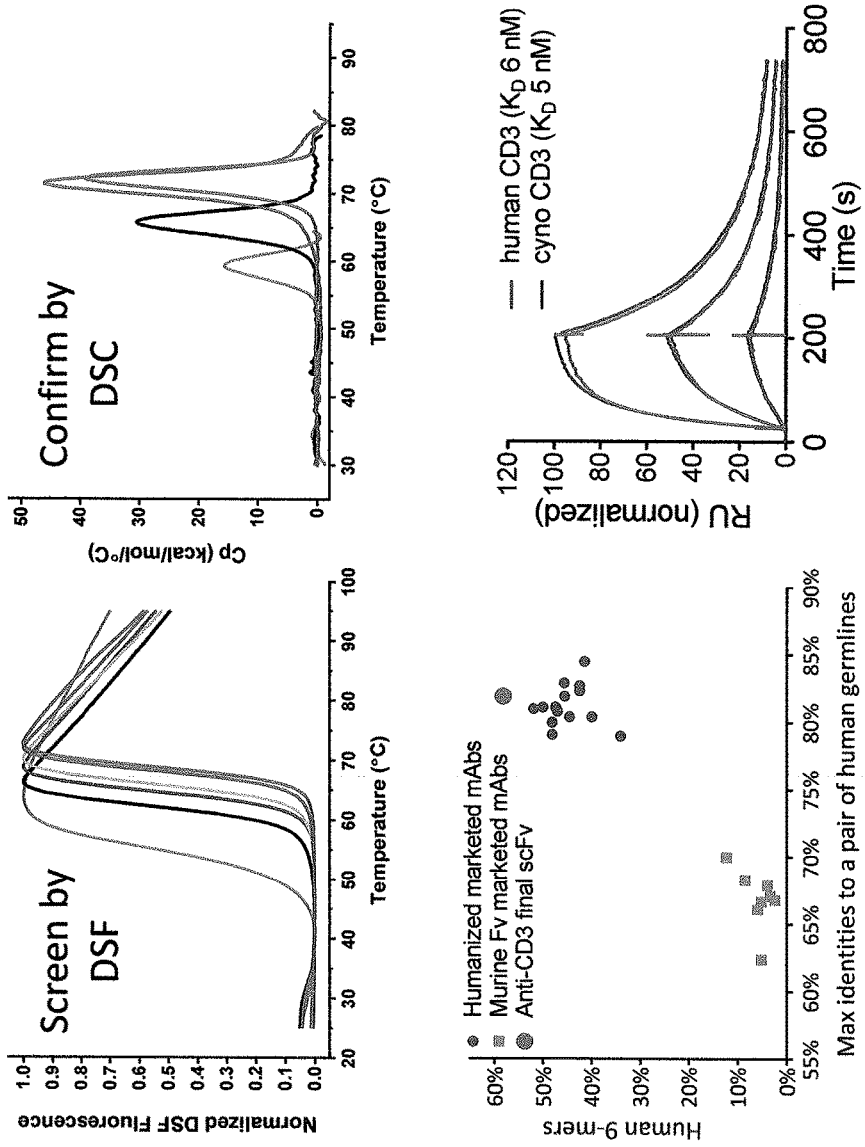
FIG. 35 depicts the optimization of a common anti-CD3 scFv-Fc. The stability was increased in a variety of ways, including replacing rare amino acids, replacing amino acids with unusual contact residues, doing linker engineering (for stability and enhanced purification, e.g. charged scFv linkers) and conversion to the VL-VH orientation.

Additional variants which find use in the present invention are those that ablate (e.g. reduce or eliminate) binding to Fcγ receptors. This can be desirable to reduce the potential mechanisms of action (e.g. reduce ADCC activity) of the heterodimeric antibodies of the invention. A number of suitable Fc ablation variants are depicted in FIG. 35, and can be optionally and independently included or excluded in combination with any other heterodimerization variants, including pI and steric variants.

Of particular use in some embodiments are a first monomer (the "negative side") that contains the pI variants N208D/Q295E/N384D/Q418E/N421D, skew variants 368D/370S, and ablation variants E233P/L234V/L235A/G236del/S267K, paired with a positive side comprising no pI variants, skew variants S364K/E357Q and ablation variants E233P/L234V/L235A/G236del/S267K (optionally both monomers containing FcRn variants 428L/434S), where the positive side is the scFv monomer and contains a charged scFv linker (particularly when the scFv is anti-CD3). A second embodiment utilizes a first negative side monomer comprising I199T/N203 D/K274Q/R355Q/Q419E/K447del, skew variants S 364K/E357Q and ablation variants E233P/L234V/L235A/G236del/S267K (optionally both monomers containing FcRn variants 428L/434S), paired with a positive side comprising pI variants Q196K/I199T/P271R/P228R/N276K, skew variants S364K/E357Q and ablation variants E233P/L234V/L235A/G236del/S267K (optionally both monomers containing FcRn variants 428L/434S), where the positive side is the scFv monomer and contains a charged scFv linker (particularly when the scFv is anti-CD3). A third embodiment utilizes a first negative side monomer comprising I199T/N203D/K274Q/R355Q/N384S/K392N/V397M/Q419E/K447del, skew variants S364K/E357Q and ablation variants E233P/L234V/L235A/G236del/S267K (optionally both monomers containing FcRn variants 428L/434S), paired with a positive side monomer with no pI variants, skew variants S364K/E357Q and ablation variants E233P/L234V/L235A/G236del/S267K (optionally both monomers containing FcRn variants 428L/434S), where the positive side is the scFv monomer and contains a charged scFv linker (particularly when the scFv is anti-CD3). A fourth embodiment a first monomer (the "negative side") that contains the pI variants N208D/Q295E/N384D/Q418E/N421D, skew variants 368D/370S, and ablation variants E233P/L234V/L235A/G236del/S239K, paired with a positive side comprising no pI variants, skew variants S364K/E357Q and ablation variants E233P/L234V/L235A/G236del/S239K (optionally both monomers containing FcRn variants 428L/434S). A fifth embodiment utilizes a first negative side monomer comprising I199T/N203 D/K274Q/R355Q/Q419E/K447del, skew variants S364K/E357Q and ablation variants E233P/L234V/L235A/G236del/S239K (optionally both monomers containing FcRn variants 428L/434S), paired with a positive side comprising pI variants Q196K/I199T/P271R/P228R/N276K, skew variants S364K/E357Q and ablation variants E233P/L234V/L235A/G236del/S239K (optionally both monomers containing FcRn variants 428L/434S). A sixth embodiment utilizes a first negative side monomer comprising I199T/N203D/K274Q/R355Q/N384S/K392N/V397M/Q419E/K447del, skew variants S364K/E357Q and ablation variants E233P/L234V/L235A/G236del/S267K (optionally both monomers containing FcRn variants 428L/434S), paired with a positive side monomer skew variants S364K/E357Q and ablation variants E233P/L234V/L235A/G236del/S239K (optionally both monomers containing FcRn variants 428L/434S), where the positive side is the scFv monomer and contains a charged scFv linker (particularly when the scFv is anti-CD3). A seventh embodiment utilizes a first monomer (the "negative side") that contains the pI variants N208D/Q295E/N384D/Q418D/N421D, skew variants 368D/370S, and ablation variants S239K/S267K, paired with a positive side comprising no pI variants, skew variants S364K/E357Q and ablation variants S239K/S267K (optionally both monomers containing FcRn variants 428L/434S), where the positive side is the scFv monomer and contains a charged scFv linker (particularly when the scFv is anti-CD3). An eighth embodiment utilizes a first negative side monomer comprising I199T/N203 D/K274Q/R355Q/Q419E/K447del, skew variants S364K/E357Q and ablation variants S239K/S267K, (optionally both monomers containing FcRn variants 428L/434S), paired with a positive side comprising pI variants Q196K/I199T/P271R/P228R/N276K, skew variants S364K/E357Q and ablation variants S239K/S267K, (optionally both monomers containing FcRn variants 428L/434S), where the positive side is the scFv monomer and contains a charged scFv linker (particularly when the scFv is anti-CD3). A ninth embodiment utilizes a first negative side monomer comprising I199T/N203 D/K274Q/R355Q/N384S/K392N/V397M/Q419E/K447del, skew variants S364K/E357Q and ablation variants S239K/S267K, (optionally both monomers containing FcRn variants 428L/434S), paired with a positive side monomer with no pI variants, skew variants S364K/E357Q and ablation variants S239K/S267K, (optionally both monomers containing FcRn variants 428L/434S), where the positive side is the scFv monomer and contains a charged scFv linker (particularly when the scFv is anti-CD3). A tenth embodiment utilizes a first monomer (the "negative side") that contains the pI variants N208D/Q295E/N384D/Q418E/N421 D, skew variants 368D/370S, and ablation variants S267K/P329K, paired with a positive side comprising no pI variants, skew variants S364K/E357Q and ablation variants S267K/P329K (optionally both monomers containing FcRn variants 428L/434S), where the positive side is the scFv monomer and contains a charged scFv linker (particularly when the scFv is anti-CD3). An eleventh embodiment utilizes a first negative side monomer comprising I199T/N203 D/K274Q/R355Q/Q419E/K447del, skew variants S364K/E357Q and ablation variants S267K/P329K (optionally both monomers containing FcRn variants 428L/434S), paired with a positive side comprising pI variants Q196K/I199T/P271R/P228R/N276K, skew variants S364K/E357Q and ablation variants S267K/P329K (optionally both monomers containing FcRn variants 428L/434S), where the positive side is the scFv monomer and contains a charged scFv linker (particularly when the scFv is anti-CD3). A 12th embodiment utilizes a first negative side monomer comprising I199T/N203 D/K274Q/R355Q/N384S/K392N/V397M/Q419E/K447del, skew variants S364K/E357Q and ablation variants S267K/P329K (optionally both monomers containing FcRn variants 428L/434S), paired with a positive side monomer with no pI variants, skew variants S364K/E357Q and ablation variants S267K/P329K (optionally both monomers containing FcRn variants 428L/434S), where the positive side is the scFv monomer and contains a charged scFv linker (particularly when the scFv is anti-CD3).

Linkers

Figure 11:
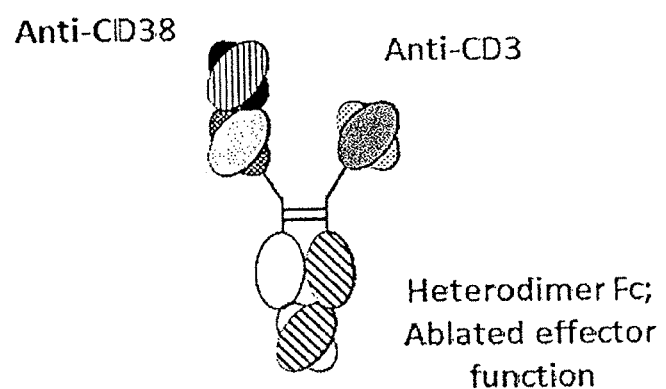
FIG. 11. Schematic showing the structure of Anti-CD38×Anti-CD3 bispecific molecule.
Figure 12:
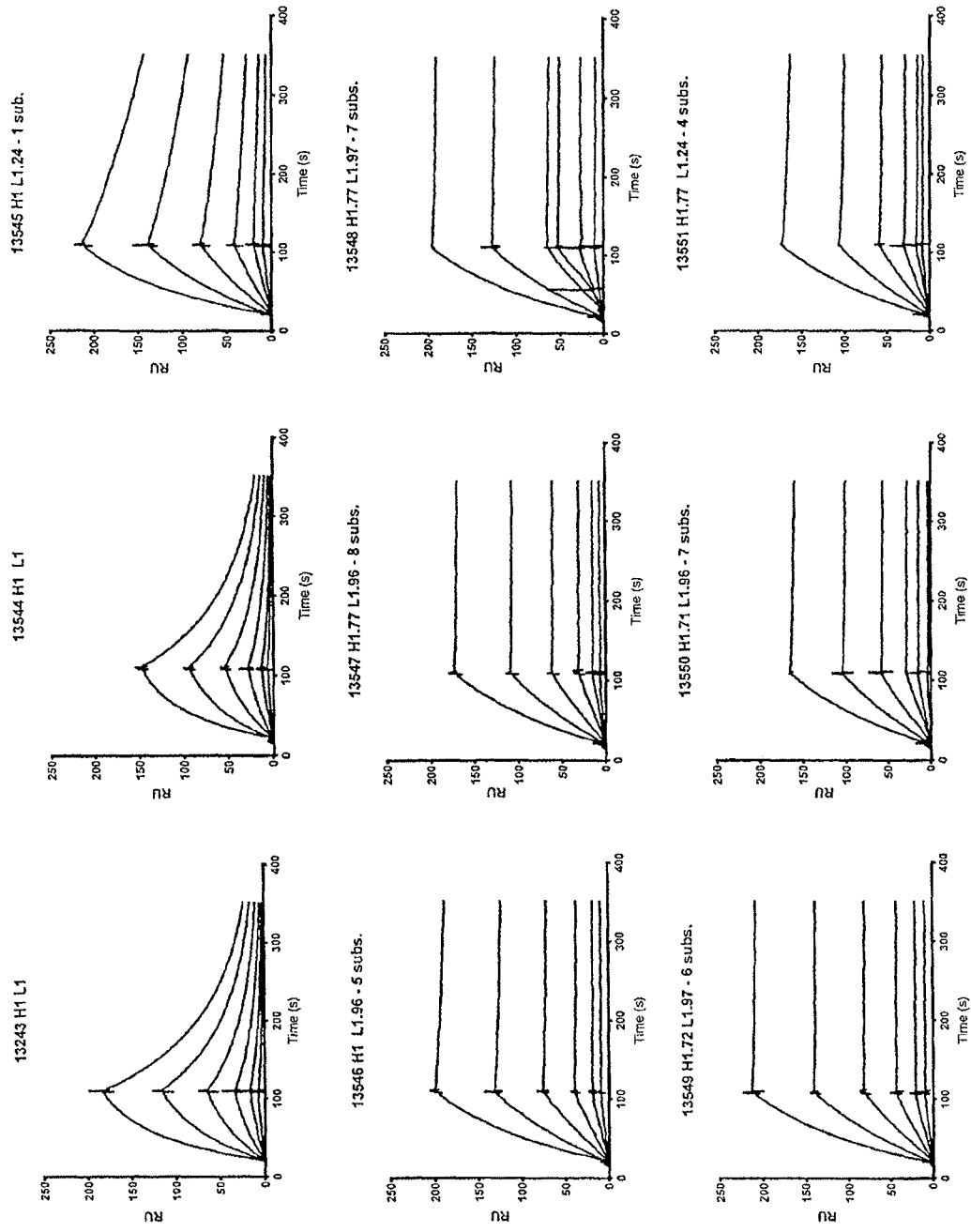
FIG. 12. Surface plasmon resonance (SPR) data of affinity/stability engineered variant Anti-CD38×Anti-CD3 bispecific molecules.
Figure 13:
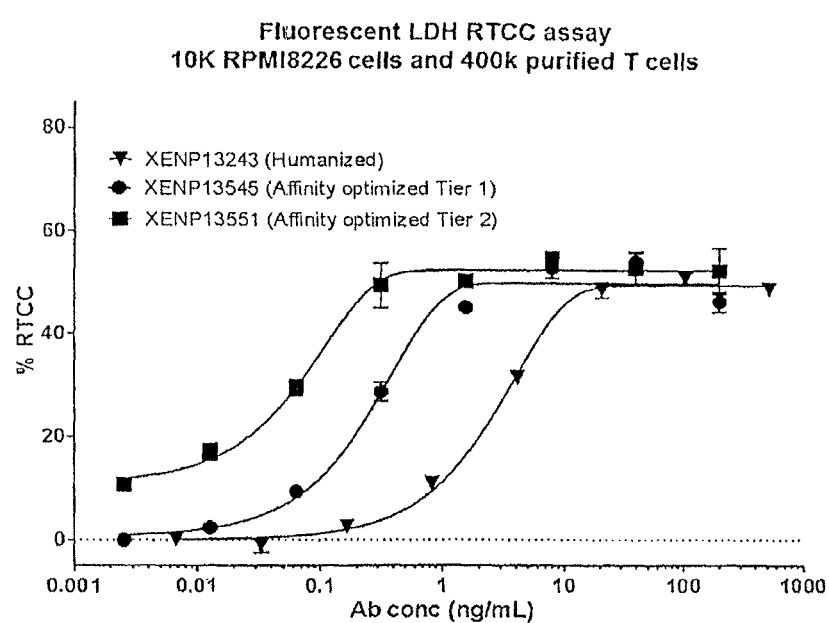
FIG. 13. Fluorescent LDH re-directed T-cell cytotoxicity (RTCC) assay showing killing of RPMI8226 multiple myeloma cells by Anti-CD28×Anti-CD3 bispecific molecules.

The present invention optionally provides linkers as needed, for example in the addition of additional antigen binding sites, as depicted for example in FIGS. 11, 12 and 13, where "the other end" of the molecule contains additional antigen binding components. In addition, as outlined below, linkers are optionally also used in antibody drug conjugate (ADC) systems. When used to join the components of the central mAb-Fv constructs, the linker is generally a polypeptide comprising two or more amino acid residues joined by peptide bonds and are used to link one or more of the components of the present invention. Such linker polypeptides are well known in the art (see e.g., Holliger, P., et al. (1993) Proc. Natl. Acad. Sci. USA 90:6444-6448; Poljak, R. J., et al. (1994) Structure 2:1121-1123). A variety of linkers may find use in some embodiments described herein. As will be appreciated by those in the art, there are at least three different linker types used in the present invention.

"Linker" herein is also referred to as "linker sequence", "spacer", "tethering sequence" or grammatical equivalents thereof. Homo- or hetero-bifunctional linkers as are well known (see, 1994 Pierce Chemical Company catalog, technical section on cross-linkers, pages 155-200, incorporated entirely by reference). (Note the distinction between generic "linkers" and "scFv linkers and "charged scFv linkers"). A number of strategies may be used to covalently link molecules together. These include, but are not limited to polypeptide linkages between N- and C-termini of proteins or protein domains, linkage via disulfide bonds, and linkage via chemical cross-linking reagents. In one aspect of this embodiment, the linker is a peptide bond, generated by recombinant techniques or peptide synthesis. The linker peptide may predominantly include the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used. Useful linkers include glycine-serine polymers, including for example (GS)n, (GSGGS)n (SEQ ID NO:539), (GGGGS)n (SEQ ID NO:429), and (GGGS)n (SEQ ID NO:540), where n is an integer of at least one, glycine-alanine polymers, alanine-serine polymers, and other flexible linkers. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers, that is may find use as linkers.

Other linker sequences may include any sequence of any length of CL/CH1 domain but not all residues of CL/CH1 domain; for example the first 5-12 amino acid residues of the CL/CH1 domains. Linkers can be derived from immunoglobulin light chain, for example Cκ or C7. Linkers can be derived from immunoglobulin heavy chains of any isotype, including for example Cγ1, Cγ2, Cγ3, Cγ4, Cα1, Cα2, Cδ, Cε, and Cμ. Linker sequences may also be derived from other proteins such as Ig-like proteins (e.g. TCR, FcR, KIR), hinge region-derived sequences, and other natural sequences from other proteins.

Antibody-Drug Conjugates

In some embodiments, the multispecific antibodies of the invention are conjugated with drugs to form antibody-drug conjugates (ADCs). In general, ADCs are used in oncology applications, where the use of antibody-drug conjugates for the local delivery of cytotoxic or cytostatic agents allows for the targeted delivery of the drug moiety to tumors, which can allow higher efficacy, lower toxicity, etc. An overview of this technology is provided in Ducry et al., Bioconjugate Chem., 21:5-13 (2010), Carter et al., Cancer J. 14(3):154 (2008) and Senter, Current Opin. Chem. Biol. 13:235-244 (2009), all of which are hereby incorporated by reference in their entirety.

Thus the invention provides multispecific antibodies conjugated to drugs. Generally, conjugation is done by covalent attachment to the antibody, as further described below, and generally relies on a linker, often a peptide linkage (which, as described below, may be designed to be sensitive to cleavage by proteases at the target site or not). In addition, as described above, linkage of the linker-drug unit (LU-D) can be done by attachment to cysteines within the antibody. As will be appreciated by those in the art, the number of drug moieties per antibody can change, depending on the conditions of the reaction, and can vary from 1:1 to 10:1 drug:antibody. As will be appreciated by those in the art, the actual number is an average.

Thus the invention provides multispecific antibodies conjugated to drugs. As described below, the drug of the ADC can be any number of agents, including but not limited to cytotoxic agents such as chemotherapeutic agents, growth inhibitory agents, toxins (for example, an enzymatically active toxin of bacterial, fungal, plant, or animal origin, or fragments thereof), or a radioactive isotope (that is, a radioconjugate) are provided. In other embodiments, the invention further provides methods of using the ADCs.

Drugs for use in the present invention include cytotoxic drugs, particularly those which are used for cancer therapy. Such drugs include, in general, DNA damaging agents, anti-metabolites, natural products and their analogs. Exemplary classes of cytotoxic agents include the enzyme inhibitors such as dihydrofolate reductase inhibitors, and thymidylate synthase inhibitors, DNA intercalators, DNA cleavers, topoisomerase inhibitors, the anthracycline family of drugs, the vinca drugs, the mitomycins, the bleomycins, the cytotoxic nucleosides, the pteridine family of drugs, diynenes, the podophyllotoxins, dolastatins, maytansinoids, differentiation inducers, and taxols.

Members of these classes include, for example, methotrexate, methopterin, dichloromethotrexate, 5-fluorouracil, 6-mercaptopurine, cytosine arabinoside, melphalan, leurosine, leurosideine, actinomycin, daunorubicin, doxorubicin, mitomycin C, mitomycin A, caminomycin, aminopterin, tallysomycin, podophyllotoxin and podophyllotoxin derivatives such as etoposide or etoposide phosphate, vinblastine, vincristine, vindesine, taxanes including taxol, taxotere retinoic acid, butyric acid, N8-acetyl spermidine, camptothecin, calicheamicin, esperamicin, ene-diynes, duocarmycin A, duocarmycin SA, calicheamicin, camptothecin, maytansinoids (including DM1), monomethylauristatin E (MMAE), monomethylauristatin F (MMAF), and maytansinoids (DM4) and their analogues.

Toxins may be used as antibody-toxin conjugates and include bacterial toxins such as diphtheria toxin, plant toxins such as ricin, small molecule toxins such as geldanamycin (Mandler et al (2000) J. Nat. Cancer Inst. 92(19):1573-1581; Mandler et al (2000) Bioorganic & Med. Chem. Letters 10:1025-1028; Mandler et al (2002) Bioconjugate Chem. 13:786-791), maytansinoids (EP 1391213; Liu et al., (1996) Proc. Natl. Acad. Sci. USA 93:8618-8623), and calicheamicin (Lode et al (1998) Cancer Res. 58:2928; Hinman et al (1993) Cancer Res. 53:3336-3342). Toxins may exert their cytotoxic and cytostatic effects by mechanisms including tubulin binding, DNA binding, or topoisomerase inhibition.

Conjugates of a multispecific antibody and one or more small molecule toxins, such as a maytansinoids, dolastatins, auristatins, a trichothecene, calicheamicin, and CC1065, and the derivatives of these toxins that have toxin activity, are contemplated.

Maytansinoids

Maytansine compounds suitable for use as maytansinoid drug moieties are well known in the art, and can be isolated from natural sources according to known methods, produced using genetic engineering techniques (see Yu et al (2002) PNAS 99:7968-7973), or maytansinol and maytansinol analogues prepared synthetically according to known methods. As described below, drugs may be modified by the incorporation of a functionally active group such as a thiol or amine group for conjugation to the antibody.

Exemplary maytansinoid drug moieties include those having a modified aromatic ring, such as: C-19-dechloro (U.S. Pat. No. 4,256,746) (prepared by lithium aluminum hydride reduction of ansamytocin P2); C-20-hydroxy (or C-20-demethyl)+/−C-19-dechloro (U.S. Pat. Nos. 4,361,650 and 4,307,016) (prepared by demethylation using *Streptomyces* or *Actinomyces* or dechlorination using LAH); and C-20-demethoxy, C-20-acyloxy (—OCOR), +/−dechloro (U.S. Pat. No. 4,294,757) (prepared by acylation using acyl chlorides) and those having modifications at other positions Exemplary maytansinoid drug moieties also include those having modifications such as: C-9-SH (U.S. Pat. No. 4,424,219) (prepared by the reaction of maytansinol with H2S or P2S5); C-14-alkoxymethyl(demethoxy/CH2OR) (U.S. Pat. No. 4,331,598); C-14-hydroxymethyl or acyloxymethyl (CH2OH or CH2OAc) (U.S. Pat. No. 4,450,254) (prepared from *Nocardia*); C-15-hydroxy/acyloxy (U.S. Pat. No. 4,364,866) (prepared by the conversion of maytansinol by *Streptomyces*); C-15-methoxy (U.S. Pat. Nos. 4,313,946 and 4,315,929) (isolated from Trewia nudlflora); C-18-N-demethyl (U.S. Pat. Nos. 4,362,663 and 4,322,348) (prepared by the demethylation of maytansinol by *Streptomyces*); and 4,5-deoxy (U.S. Pat. No. 4,371,533) (prepared by the titanium trichloride/LAH reduction of maytansinol).

Of particular use are DM1 (disclosed in U.S. Pat. No. 5,208,020, incorporated by reference) and DM4 (disclosed in U.S. Pat. No. 7,276,497, incorporated by reference). See also a number of additional maytansinoid derivatives and methods in U.S. Pat. No. 5,416,064, WO/01/24763, 7,303,749, 7,601,354, U.S. Ser. No. 12/631,508, WO02/098883, U.S. Pat. Nos. 6,441,163, 7,368,565, WO02/16368 and WO04/1033272, all of which are expressly incorporated by reference in their entirety.

ADCs containing maytansinoids, methods of making same, and their therapeutic use are disclosed, for example, in U.S. Pat. Nos. 5,208,020; 5,416,064; 6,441,163 and European Patent EP 0 425 235 BI, the disclosures of which are hereby expressly incorporated by reference. Liu et al., Proc. Natl. Acad. Sci. USA 93:8618-8623 (1996) described ADCs comprising a maytansinoid designated DM1 linked to the monoclonal antibody C242 directed against human colorectal cancer. The conjugate was found to be highly cytotoxic towards cultured colon cancer cells, and showed antitumor activity in an in vivo tumor growth assay.

Chari et al., Cancer Research 52:127-131 (1992) describe ADCs in which a maytansinoid was conjugated via a disulfide linker to the murine antibody A7 binding to an antigen on human colon cancer cell lines, or to another murine monoclonal antibody TA. 1 that binds the HER-2/neu oncogene. The cytotoxicity of the TA. 1-maytansonoid conjugate was tested in vitro on the human breast cancer cell line SK-BR-3, which expresses 3×105 HER-2 surface antigens per cell. The drug conjugate achieved a degree of cytotoxicity similar to the free maytansinoid drug, which could be increased by increasing the number of maytansinoid molecules per antibody molecule. The A7-maytansinoid conjugate showed low systemic cytotoxicity in mice.

Auristatins and Dolastatins

In some embodiments, the ADC comprises a multispecific antibody conjugated to dolastatins or dolostatin peptidic analogs and derivatives, the auristatins (U.S. Pat. Nos. 5,635,483; 5,780,588). Dolastatins and auristatins have been shown to interfere with microtubule dynamics, GTP hydrolysis, and nuclear and cellular division (Woyke et al (2001) Antimicrob. Agents and Chemother. 45(12):3580-3584) and have anticancer (U.S. Pat. No. 5,663,149) and antifungal activity (Pettit et al (1998) Antimicrob. Agents Chemother. 42:2961-2965). The dolastatin or auristatin drug moiety may be attached to the antibody through the N (amino) terminus or the C (carboxyl) terminus of the peptidic drug moiety (WO 02/088172).

Exemplary auristatin embodiments include the N-terminus linked monomethylauristatin drug moieties DE and DF, disclosed in "Senter et al, Proceedings of the American Association for Cancer Research, Volume 45, Abstract Number 623, presented Mar. 28, 2004 and described in United States Patent Publication No. 2005/0238648, the disclosure of which is expressly incorporated by reference in its entirety.

An exemplary auristatin embodiment is MMAE (see U.S. Pat. No. 6,884,869 expressly incorporated by reference in its entirety).

Another exemplary auristatin embodiment is MMAF (see US 2005/0238649, U.S. Pat. Nos. 5,767,237 and 6,124,431, expressly incorporated by reference in their entirety).

Additional exemplary embodiments comprising MMAE or MMAF and various linker components (described further herein) have the following structures and abbreviations (wherein Ab means antibody and p is 1 to about 8):

Typically, peptide-based drug moieties can be prepared by forming a peptide bond between two or more amino acids and/or peptide fragments. Such peptide bonds can be prepared, for example, according to the liquid phase synthesis method (see E. Schroder and K. Lubke, "The Peptides", volume 1, pp 76-136, 1965, Academic Press) that is well known in the field of peptide chemistry. The auristatin/dolastatin drug moieties may be prepared according to the methods of: U.S. Pat. Nos. 5,635,483; 5,780,588; Pettit et al (1989) J. Am. Chem. Soc. 111:5463-5465; Pettit et al (1998) Anti-Cancer Drug Design 13:243-277; Pettit, G. R., et al. Synthesis, 1996, 719-725; Pettit et al (1996) J. Chem. Soc. Perkin Trans. 1 5:859-863; and Doronina (2003) Nat Biotechnol 21(7):778-784.

Calicheamicin

In other embodiments, the ADC comprises an antibody of the invention conjugated to one or more calicheamicin molecules. For example, Mylotarg is the first commercial ADC drug and utilizes calicheamicin γ1 as the payload (see U.S. Pat. No. 4,970,198, incorporated by reference in its entirety). Additional calicheamicin derivatives are described in U.S. Pat. Nos. 5,264,586, 5,384,412, 5,550,246, 5,739,116, 5,773,001, 5,767,285 and 5,877,296, all expressly incorporated by reference. The calicheamicin family of antibiotics are capable of producing double-stranded DNA breaks at sub-picomolar concentrations. For the preparation of conjugates of the calicheamicin family, see U.S. Pat. Nos. 5,712,374, 5,714,586, 5,739,116, 5,767,285, 5,770,701, 5,770,710, 5,773,001, 5,877,296 (all to American Cyanamid Company). Structural analogues of calicheamicin which may be used include, but are not limited to, γ1I, α2I, α2I, N-acetyl-γ1I, PSAG and θI1 (Hinman et al., Cancer Research 53:3336-3342 (1993), Lode et al., Cancer Research 58:2925-2928 (1998) and the aforementioned U.S. patents to American Cyanamid). Another anti-tumor drug that the antibody can be conjugated is QFA which is an antifolate. Both calicheamicin and QFA have intracellular sites of action and do not readily cross the plasma membrane. Therefore, cellular uptake of these agents through antibody mediated internalization greatly enhances their cytotoxic effects.

Duocarmycins

CC-1065 (see U.S. Pat. No. 4,169,888, incorporated by reference) and duocarmycins are members of a family of antitumor antibiotics utilized in ADCs. These antibiotics appear to work through sequence-selectively alkylating DNA at the N3 of adenine in the minor groove, which initiates a cascade of events that result in apoptosis.

Important members of the duocarmycins include duocarmycin A (U.S. Pat. No. 4,923,990, incorporated by reference) and duocarmycin SA (U.S. Pat. No. 5,101,038, incorporated by reference), and a large number of analogues as described in U.S. Pat. Nos. 7,517,903, 7,691,962, 5,101,038; 5,641,780; 5,187,186; 5,070,092; 5,070,092; 5,641,780; 5,101,038; 5,084,468, 5,475,092, 5,585,499, 5,846,545, WO2007/089149, WO2009/017394A1, U.S. Pat. Nos. 5,703,080, 6,989,452, 7,087,600, 7,129,261, 7,498,302, and 7,507,420, all of which are expressly incorporated by reference.

Other Cytotoxic Agents

Other antitumor agents that can be conjugated to the antibodies of the invention include BCNU, streptozoicin, vincristine and 5-fluorouracil, the family of agents known collectively LL-E33288 complex described in U.S. Pat. Nos. 5,053,394, 5,770,710, as well as esperamicins (U.S. Pat. No. 5,877,296).

Enzymatically active toxins and fragments thereof which can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin and the tricothecenes. See, for example, WO 93/21232 published Oct. 28, 1993.

The present invention further contemplates an ADC formed between an antibody and a compound with nucleolytic activity (e.g., a ribonuclease or a DNA endonuclease such as a deoxyribonuclease; DNase).

For selective destruction of the tumor, the antibody may comprise a highly radioactive atom. A variety of radioactive isotopes are available for the production of radioconjugated antibodies. Examples include At211, I131, I125, Y90, Re186, Re188, Sm153, Bi212, P32, Pb212 and radioactive isotopes of Lu.

The radio- or other labels may be incorporated in the conjugate in known ways. For example, the peptide may be biosynthesized or may be synthesized by chemical amino acid synthesis using suitable amino acid precursors involving, for example, fluorine-19 in place of hydrogen. Labels such as Tc99m or I123, Re186, Re188 and In111 can be attached via a cysteine residue in the peptide. Yttrium-90 can be attached via a lysine residue. The IODOGEN method (Fraker et al (1978) Biochem. Biophys. Res. Commun. 80: 49-57 can be used to incorporate Iodine-123. "Monoclonal Antibodies in Immunoscintigraphy" (Chatal, CRC Press 1989) describes other methods in detail.

For compositions comprising a plurality of antibodies, the drug loading is represented by p, the average number of drug molecules per Antibody. Drug loading may range from 1 to 20 drugs (D) per Antibody. The average number of drugs per antibody in preparation of conjugation reactions may be characterized by conventional means such as mass spectroscopy, ELISA assay, and HPLC. The quantitative distribution of Antibody-Drug-Conjugates in terms of p may also be determined.

In some instances, separation, purification, and characterization of homogeneous Antibody-Drug-conjugates where p is a certain value from Antibody-Drug-Conjugates with other drug loadings may be achieved by means such as reverse phase HPLC or electrophoresis. In exemplary embodiments, p is 2, 3, 4, 5, 6, 7, or 8 or a fraction thereof.

The generation of Antibody-drug conjugate compounds can be accomplished by any technique known to the skilled artisan. Briefly, the Antibody-drug conjugate compounds can include a multispecific antibody as the Antibody unit, a drug, and optionally a linker that joins the drug and the binding agent.

A number of different reactions are available for covalent attachment of drugs and/or linkers to binding agents. This is can be accomplished by reaction of the amino acid residues of the binding agent, for example, antibody molecule, including the amine groups of lysine, the free carboxylic acid groups of glutamic and aspartic acid, the sulfhydryl groups of cysteine and the various moieties of the aromatic amino acids. A commonly used non-specific methods of covalent attachment is the carbodiimide reaction to link a carboxy (or amino) group of a compound to amino (or carboxy) groups of the antibody. Additionally, bifunctional agents such as dialdehydes or imidoesters have been used to link the amino group of a compound to amino groups of an antibody molecule.

Also available for attachment of drugs to binding agents is the Schiff base reaction. This method involves the periodate oxidation of a drug that contains glycol or hydroxy groups, thus forming an aldehyde which is then reacted with the binding agent. Attachment occurs via formation of a Schiff base with amino groups of the binding agent. Isothiocyanates can also be used as coupling agents for covalently attaching drugs to binding agents. Other techniques are known to the skilled artisan and within the scope of the present invention.

In some embodiments, an intermediate, which is the precursor of the linker, is reacted with the drug under appropriate conditions. In other embodiments, reactive groups are used on the drug and/or the intermediate. The product of the reaction between the drug and the intermediate, or the derivatized drug, is subsequently reacted with an multispecific antibody of the invention under appropriate conditions.

It will be understood that chemical modifications may also be made to the desired compound in order to make reactions of that compound more convenient for purposes of preparing conjugates of the invention. For example a functional group e.g. amine, hydroxyl, or sulfhydryl, may be appended to the drug at a position which has minimal or an acceptable effect on the activity or other properties of the drug Linker Units Typically, the antibody-drug conjugate compounds comprise a Linker unit between the drug unit and the antibody unit. In some embodiments, the linker is cleavable under intracellular or extracellular conditions, such that cleavage of the linker releases the drug unit from the antibody in the appropriate environment. For example, solid tumors that secrete certain proteases may serve as the target of the cleavable linker; in other embodiments, it is the intracellular proteases that are utilized. In yet other embodiments, the linker unit is not cleavable and the drug is released, for example, by antibody degradation in lysosomes.

In some embodiments, the linker is cleavable by a cleaving agent that is present in the intracellular environment (for example, within a lysosome or endosome or caveolea). The linker can be, for example, a peptidyl linker that is cleaved by an intracellular peptidase or protease enzyme, including, but not limited to, a lysosomal or endosomal protease. In some embodiments, the peptidyl linker is at least two amino acids long or at least three amino acids long or more.

Cleaving agents can include, without limitation, cathepsins B and D and plasmin, all of which are known to hydrolyze dipeptide drug derivatives resulting in the release of active drug inside target cells (see, e.g., Dubowchik and Walker, 1999, Pharm. Therapeutics 83:67-123). Peptidyl linkers that are cleavable by enzymes that are present in CD38-expressing cells. For example, a peptidyl linker that is cleavable by the thiol-dependent protease cathepsin-B, which is highly expressed in cancerous tissue, can be used (e.g., a Phe-Leu or a Gly-Phe-Leu-Gly linker (SEQ ID NO: X)). Other examples of such linkers are described, e.g., in U.S. Pat. No. 6,214,345, incorporated herein by reference in its entirety and for all purposes.

In some embodiments, the peptidyl linker cleavable by an intracellular protease is a Val-Cit linker or a Phe-Lys linker (see, e.g., U.S. Pat. No. 6,214,345, which describes the synthesis of doxorubicin with the val-cit linker).

In other embodiments, the cleavable linker is pH-sensitive, that is, sensitive to hydrolysis at certain pH values. Typically, the pH-sensitive linker hydrolyzable under acidic conditions. For example, an acid-labile linker that is hydrolyzable in the lysosome (for example, a hydrazone, semicarbazone, thiosemicarbazone, cis-aconitic amide, orthoester, acetal, ketal, or the like) may be used. (See, e.g., U.S. Pat. Nos. 5,122,368; 5,824,805; 5,622,929; Dubowchik and Walker, 1999, Pharm. Therapeutics 83:67-123; Neville et al., 1989, Biol. Chem. 264:14653-14661.) Such linkers are relatively stable under neutral pH conditions, such as those in the blood, but are unstable at below pH 5.5 or 5.0, the approximate pH of the lysosome. In certain embodiments, the hydrolyzable linker is a thioether linker (such as, e.g., a thioether attached to the therapeutic agent via an acylhydrazone bond (see, e.g., U.S. Pat. No. 5,622,929).

In yet other embodiments, the linker is cleavable under reducing conditions (for example, a disulfide linker). A variety of disulfide linkers are known in the art, including, for example, those that can be formed using SATA (N-succinimidyl-5-acetylthioacetate), SPDP (N-succinimidyl-3-(2-pyridyldithio)propionate), SPDB (N-succinimidyl-3-(2-pyridyldithio)butyrate) and SMPT (N-succinimidyl-oxycarbonyl-alpha-methyl-alpha-(2-pyridyl-dithio)-toluene)-, SPDB and SMPT. (See, e.g., Thorpe et al., 1987, Cancer Res. 47:5924-5931; Wawrzynczak et al., In Immunoconjugates: Antibody Conjugates in Radioimagery and Therapy of Cancer (C. W. Vogel ed., Oxford U. Press, 1987. See also U.S. Pat. No. 4,880,935.)

In other embodiments, the linker is a malonate linker (Johnson et al., 1995, Anticancer Res. 15:1387-93), a maleimidobenzoyl linker (Lau et al., 1995, Bioorg-Med-Chem. 3(10):1299-1304), or a 3'-N-amide analog (Lau et al., 1995, Bioorg-Med-Chem. 3(10):1305-12).

In yet other embodiments, the linker unit is not cleavable and the drug is released by antibody degradation. (See U.S. Publication No. 2005/023 8649 incorporated by reference herein in its entirety and for all purposes).

In many embodiments, the linker is self-immolative. As used herein, the term "self-immolative Spacer" refers to a bifunctional chemical moiety that is capable of covalently linking together two spaced chemical moieties into a stable tripartite molecule. It will spontaneously separate from the second chemical moiety if its bond to the first moiety is cleaved. See for example, WO 2007059404A2, WO06110476A2, WO05112919A2, WO2010/062171, WO09/017394, WO07/089149, WO 07/018431, WO04/043493 and WO02/083180, which are directed to drug-cleavable substrate conjugates where the drug and cleavable substrate are optionally linked through a self-immolative linker and which are all expressly incorporated by reference.

Often the linker is not substantially sensitive to the extracellular environment. As used herein, "not substantially sensitive to the extracellular environment," in the context of a linker, means that no more than about 20%, 15%, 10%, 5%, 3%, or no more than about 1% of the linkers, in a sample of antibody-drug conjugate compound, are cleaved when the antibody-drug conjugate compound presents in an extracellular environment (for example, in plasma).

Whether a linker is not substantially sensitive to the extracellular environment can be determined, for example, by incubating with plasma the antibody-drug conjugate compound for a predetermined time period (for example, 2, 4, 8, 16, or 24 hours) and then quantitating the amount of free drug present in the plasma.

In other, non-mutually exclusive embodiments, the linker promotes cellular internalization. In certain embodiments, the linker promotes cellular internalization when conjugated to the therapeutic agent (that is, in the milieu of the linker-therapeutic agent moiety of the antibody-drug conjugate compound as described herein). In yet other embodiments, the linker promotes cellular internalization when conjugated to both the auristatin compound and the multispecific antibodies of the invention.

A variety of exemplary linkers that can be used with the present compositions and methods are described in WO 2004-010957, U.S. Publication No. 2006/0074008, U.S. Publication No. 20050238649, and U.S. Publication No. 2006/0024317 (each of which is incorporated by reference herein in its entirety and for all purposes).

Drug Loading

Drug loading is represented by p and is the average number of Drug moieties per antibody in a molecule. Drug loading ("p") may be 1, 2, 3, 4, 5, 6, 7, 8, 9, 10, 11, 12, 13, 14, 15, 16, 17, 18, 19, 20 or more moieties (D) per antibody, although frequently the average number is a fraction or a decimal. Generally, drug loading of from 1 to 4 is frequently useful, and from 1 to 2 is also useful. ADCs of the invention include collections of antibodies conjugated with a range of drug moieties, from 1 to 20. The average number of drug moieties per antibody in preparations of ADC from conjugation reactions may be characterized by conventional means such as mass spectroscopy and, ELISA assay.

The quantitative distribution of ADC in terms of p may also be determined. In some instances, separation, purification, and characterization of homogeneous ADC where p is a certain value from ADC with other drug loadings may be achieved by means such as electrophoresis.

For some antibody-drug conjugates, p may be limited by the number of attachment sites on the antibody. For example, where the attachment is a cysteine thiol, as in the exemplary embodiments above, an antibody may have only one or several cysteine thiol groups, or may have only one or several sufficiently reactive thiol groups through which a linker may be attached. In certain embodiments, higher drug loading, e.g. p>5, may cause aggregation, insolubility, toxicity, or loss of cellular permeability of certain antibody-drug conjugates. In certain embodiments, the drug loading for an ADC of the invention ranges from 1 to about 8; from about 2 to about 6; from about 3 to about 5; from about 3 to about 4; from about 3.1 to about 3.9; from about 3.2 to about 3.8; from about 3.2 to about 3.7; from about 3.2 to about 3.6; from about 3.3 to about 3.8; or from about 3.3 to about 3.7. Indeed, it has been shown that for certain ADCs, the optimal ratio of drug moieties per antibody may be less than 8, and may be about 2 to about 5. See US 2005-0238649 A1 (herein incorporated by reference in its entirety).

In certain embodiments, fewer than the theoretical maximum of drug moieties are conjugated to an antibody during a conjugation reaction. An antibody may contain, for example, lysine residues that do not react with the drug-linker intermediate or linker reagent, as discussed below. Generally, antibodies do not contain many free and reactive cysteine thiol groups which may be linked to a drug moiety; indeed most cysteine thiol residues in antibodies exist as disulfide bridges. In certain embodiments, an antibody may be reduced with a reducing agent such as dithiothreitol (DTT) or tricarbonylethylphosphine (TCEP), under partial or total reducing conditions, to generate reactive cysteine thiol groups. In certain embodiments, an antibody is subjected to denaturing conditions to reveal reactive nucleophilic groups such as lysine or cysteine.

The loading (drug/antibody ratio) of an ADC may be controlled in different ways, e.g., by: (i) limiting the molar excess of drug-linker intermediate or linker reagent relative to antibody, (ii) limiting the conjugation reaction time or temperature, (iii) partial or limiting reductive conditions for cysteine thiol modification, (iv) engineering by recombinant techniques the amino acid sequence of the antibody such that the number and position of cysteine residues is modified for control of the number and/or position of linker-drug attachments (such as thioMab or thioFab prepared as disclosed herein and in WO2006/034488 (herein incorporated by reference in its entirety)).

It is to be understood that where more than one nucleophilic group reacts with a drug-linker intermediate or linker reagent followed by drug moiety reagent, then the resulting product is a mixture of ADC compounds with a distribution of one or more drug moieties attached to an antibody. The average number of drugs per antibody may be calculated from the mixture by a dual ELISA antibody assay, which is specific for antibody and specific for the drug. Individual ADC molecules may be identified in the mixture by mass spectroscopy and separated by HPLC, e.g. hydrophobic interaction chromatography.

In some embodiments, a homogeneous ADC with a single loading value may be isolated from the conjugation mixture by electrophoresis or chromatography.

Methods of Determining cytotoxic Effect of ADCs

Methods of determining whether a Drug or Antibody-Drug conjugate exerts a cytostatic and/or cytotoxic effect on a cell are known. Generally, the cytotoxic or cytostatic activity of an Antibody Drug conjugate can be measured by: exposing mammalian cells expressing a target protein of the Antibody Drug conjugate in a cell culture medium; culturing the cells for a period from about 6 hours to about 5 days; and measuring cell viability. Cell-based in vitro assays can be used to measure viability (proliferation), cytotoxicity, and induction of apoptosis (caspase activation) of the Antibody Drug conjugate.

For determining whether an Antibody Drug conjugate exerts a cytostatic effect, a thymidine incorporation assay may be used. For example, cancer cells expressing a target antigen at a density of 5,000 cells/well of a 96-well plated can be cultured for a 72-hour period and exposed to 0.5 µCi of 3H-thymidine during the final 8 hours of the 72-hour period. The incorporation of 3H-thymidine into cells of the culture is measured in the presence and absence of the Antibody Drug conjugate.

For determining cytotoxicity, necrosis or apoptosis (programmed cell death) can be measured. Necrosis is typically accompanied by increased permeability of the plasma membrane; swelling of the cell, and rupture of the plasma membrane. Apoptosis is typically characterized by membrane blebbing, condensation of cytoplasm, and the activation of endogenous endonucleases. Determination of any of these effects on cancer cells indicates that an Antibody Drug conjugate is useful in the treatment of cancers.

Cell viability can be measured by determining in a cell the uptake of a dye such as neutral red, trypan blue, or ALAMAR™ blue (see, e.g., Page et al., 1993, Intl. J. Oncology 3:473-476). In such an assay, the cells are incubated in media containing the dye, the cells are washed, and the remaining dye, reflecting cellular uptake of the dye, is measured spectrophotometrically. The protein-binding dye sulforhodamine B (SRB) can also be used to measure cytotoxicity (Skehan et al., 1990, J. Natl. Cancer Inst. 82:1107-12).

Alternatively, a tetrazolium salt, such as MTT, is used in a quantitative colorimetric assay for mammalian cell survival and proliferation by detecting living, but not dead, cells (see, e.g., Mosmann, 1983, J. Immunol. Methods 65:55-63).

Apoptosis can be quantitated by measuring, for example, DNA fragmentation. Commercial photometric methods for the quantitative in vitro determination of DNA fragmentation are available. Examples of such assays, including TUNEL (which detects incorporation of labeled nucleotides in fragmented DNA) and ELISA-based assays, are described in Biochemica, 1999, no. 2, pp. 34-37 (Roche Molecular Biochemicals).

Apoptosis can also be determined by measuring morphological changes in a cell. For example, as with necrosis, loss of plasma membrane integrity can be determined by measuring uptake of certain dyes (e.g., a fluorescent dye such as, for example, acridine orange or ethidium bromide). A method for measuring apoptotic cell number has been described by Duke and Cohen, Current Protocols in Immunology (Coligan et al. eds., 1992, pp. 3.17.1-3.17.16). Cells also can be labeled with a DNA dye (e.g., acridine orange, ethidium bromide, or propidium iodide) and the cells observed for chromatin condensation and margination along the inner nuclear membrane. Other morphological changes that can be measured to determine apoptosis include, e.g., cytoplasmic condensation, increased membrane blebbing, and cellular shrinkage.

The presence of apoptotic cells can be measured in both the attached and "floating" compartments of the cultures. For example, both compartments can be collected by removing the supernatant, trypsinizing the attached cells, combining the preparations following a centrifugation wash step (e.g., 10 minutes at 2000 rpm), and detecting apoptosis (e.g., by measuring DNA fragmentation). (See, e.g., Piazza et al., 1995, Cancer Research 55:3110-16).

In vivo, the effect of a therapeutic composition of the multispecific antibody of the invention can be evaluated in a suitable animal model. For example, xenogenic cancer models can be used, wherein cancer explants or passaged xenograft tissues are introduced into immune compromised animals, such as nude or SCID mice (Klein et al., 1997, Nature Medicine 3: 402-408). Efficacy can be measured using assays that measure inhibition of tumor formation, tumor regression or metastasis, and the like.

The therapeutic compositions used in the practice of the foregoing methods can be formulated into pharmaceutical compositions comprising a carrier suitable for the desired delivery method. Suitable carriers include any material that when combined with the therapeutic composition retains the anti-tumor function of the therapeutic composition and is generally non-reactive with the patient's immune system. Examples include, but are not limited to, any of a number of standard pharmaceutical carriers such as sterile phosphate buffered saline solutions, bacteriostatic water, and the like (see, generally, Remington's Pharmaceutical Sciences 16th Edition, A. Osal., Ed., 1980).

Antibody Compositions for In Vivo Administration

Formulations of the antibodies used in accordance with the present invention are prepared for storage by mixing an antibody having the desired degree of purity with optional pharmaceutically acceptable carriers, excipients or stabilizers (Remington's Pharmaceutical Sciences 16th edition, Osol, A. Ed. [1980]), in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as TWEEN™, PLURONICS™ or polyethylene glycol (PEG).

The formulation herein may also contain more than one active compound as necessary for the particular indication being treated, preferably those with complementary activities that do not adversely affect each other. For example, it may be desirable to provide antibodies with other specifcities. Alternatively, or in addition, the composition may comprise a cytotoxic agent, cytokine, growth inhibitory agent and/or small molecule antagonist. Such molecules are suitably present in combination in amounts that are effective for the purpose intended.

The active ingredients may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences 16th edition, Osol, A. Ed. (1980).

The formulations to be used for in vivo administration should be sterile, or nearly so. This is readily accomplished by filtration through sterile filtration membranes.

Sustained-release preparations may be prepared. Suitable examples of sustained-release preparations include semipermeable matrices of solid hydrophobic polymers containing the antibody, which matrices are in the form of shaped articles, e.g. films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and .gamma.ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxybutyric acid. While polymers such as ethylene-vinyl acetate and lactic acid-glycolic acid enable release of molecules for over 100 days, certain hydrogels release proteins for shorter time periods.

When encapsulated antibodies remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization may be achieved by modifying sulfhydryl residues, lyophilizing from acidic solutions, controlling moisture content, using appropriate additives, and developing specific polymer matrix compositions.

Administrative Modalities

The antibodies and chemotherapeutic agents of the invention are administered to a subject, in accord with known methods, such as intravenous administration as a bolus or by continuous infusion over a period of time, by intramuscular, intraperitoneal, intracerobrospinal, subcutaneous, intra-articular, intrasynovial, intrathecal, oral, topical, or inhalation routes. Intravenous or subcutaneous administration of the antibody is preferred.

Treatment Modalities

In the methods of the invention, therapy is used to provide a positive therapeutic response with respect to a disease or condition. By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MRI) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Thus for B cell tumors, the subject may experience a decrease in the so-called B symptoms, i.e., night sweats, fever, weight loss, and/or urticaria. For pre-malignant conditions, therapy with an multispecific therapeutic agent may block and/or prolong the time before development of a related malignant condition, for example, development of multiple myeloma in subjects suffering from monoclonal gammopathy of undetermined significance (MGUS).

An improvement in the disease may be characterized as a complete response. By "complete response" is intended an absence of clinically detectable disease with normalization of any previously abnormal radiographic studies, bone marrow, and cerebrospinal fluid (CSF) or abnormal monoclonal protein in the case of myeloma.

Such a response may persist for at least 4 to 8 weeks, or sometimes 6 to 8 weeks, following treatment according to the methods of the invention. Alternatively, an improvement in the disease may be categorized as being a partial response. By "partial response" is intended at least about a 50% decrease in all measurable tumor burden (i.e., the number of malignant cells present in the subject, or the measured bulk of tumor masses or the quantity of abnormal monoclonal protein) in the absence of new lesions, which may persist for 4 to 8 weeks, or 6 to 8 weeks.

Treatment according to the present invention includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the antibody or antibody portion are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound to inhibit cell growth or to induce apoptosis by in vitro assays known to the skilled practitioner. A therapeutically effective amount of a therapeutic compound may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the present invention are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the multispecific antibodies used in the present invention depend on the disease or condition to be treated and may be determined by the persons skilled in the art.

An exemplary, non-limiting range for a therapeutically effective amount of an multispecific antibody used in the present invention is about 0.1-100 mg/kg, such as about 0.1-50 mg/kg, for example about 0.1-20 mg/kg, such as about 0.1-10 mg/kg, for instance about 0.5, about such as 0.3, about 1, or about 3 mg/kg. In another embodiment, he antibody is administered in a dose of 1 mg/kg or more, such as a dose of from 1 to 20 mg/kg, e.g. a dose of from 5 to 20 mg/kg, e.g. a dose of 8 mg/kg.

A medical professional having ordinary skill in the art may readily determine and prescribe the effective amount of the pharmaceutical composition required. For example, a physician or a veterinarian could start doses of the medicament employed in the pharmaceutical composition at levels lower than that required in order to achieve the desired therapeutic effect and gradually increase the dosage until the desired effect is achieved.

In one embodiment, the multispecific antibody is administered by infusion in a weekly dosage of from 10 to 500 mg/kg such as of from 200 to 400 mg/kg Such administration may be repeated, e.g., 1 to 8 times, such as 3 to 5 times. The administration may be performed by continuous infusion over a period of from 2 to 24 hours, such as of from 2 to 12 hours.

In one embodiment, the multispecific antibody is administered by slow continuous infusion over a long period, such as more than 24 hours, if required to reduce side effects including toxicity.

In one embodiment the multispecific antibody is administered in a weekly dosage of from 250 mg to 2000 mg, such as for example 300 mg, 500 mg, 700 mg, 1000 mg, 1500 mg or 2000 mg, for up to 8 times, such as from 4 to 6 times. The administration may be performed by continuous infusion over a period of from 2 to 24 hours, such as of from 2 to 12 hours. Such regimen may be repeated one or more times as necessary, for example, after 6 months or 12 months. The dosage may be determined or adjusted by measuring the amount of compound of the present invention in the blood upon administration by for instance taking out a biological sample and using anti-idiotypic antibodies which target the antigen binding region of the multispecific antibody.

In a further embodiment, the multispecific antibody is administered once weekly for 2 to 12 weeks, such as for 3 to 10 weeks, such as for 4 to 8 weeks.

In one embodiment, the multispecific antibody is administered by maintenance therapy, such as, e.g., once a week for a period of 6 months or more.

In one embodiment, the multispecific antibody is administered by a regimen including one infusion of an multispecific antibody followed by an infusion of an multispecific antibody conjugated to a radioisotope. The regimen may be repeated, e.g., 7 to 9 days later.

As non-limiting examples, treatment according to the present invention may be provided as a daily dosage of an antibody in an amount of about 0.1-100 mg/kg, such as 0.5, 0.9, 1.0, 1.1, 1.5, 2, 3, 4, 5, 6, 7, 8, 9, 10, 11, 12, 13, 14, 15, 16, 17, 18, 19, 20, 21, 22, 23, 24, 25, 26, 27, 28, 29, 30, 40, 45, 50, 60, 70, 80, 90 or 100 mg/kg, per day, on at least one of day 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40, or alternatively, at least one of week 1, 2, 3, 4, 5, 6, 7, 8, 9, 10, 11, 12, 13, 14, 15, 16, 17, 18, 19 or 20 after initiation of treatment, or any combination thereof, using single or divided doses of every 24, 12, 8, 6, 4, or 2 hours, or any combination thereof.

In some embodiments the multispecific antibody molecule thereof is used in combination with one or more additional therapeutic agents, e.g. a chemotherapeutic agent. Non-limiting examples of DNA damaging chemotherapeutic agents include topoisomerase I inhibitors (e.g., irinotecan, topotecan, camptothecin and analogs or metabolites thereof, and doxorubicin); topoisomerase II inhibitors (e.g., etoposide, teniposide, and daunorubicin); alkylating agents (e.g., melphalan, chlorambucil, busulfan, thiotepa, ifosfamide, carmustine, lomustine, semustine, streptozocin, decarbazine, methotrexate, mitomycin C, and cyclophosphamide); DNA intercalators (e.g., cisplatin, oxaliplatin, and carboplatin); DNA intercalators and free radical generators such as bleomycin; and nucleoside mimetics (e.g., 5-fluorouracil, capecitibine, gemcitabine, fludarabine, cytarabine, mercaptopurine, thioguanine, pentostatin, and hydroxyurea).

Chemotherapeutic agents that disrupt cell replication include: paclitaxel, docetaxel, and related analogs; vincristine, vinblastin, and related analogs; thalidomide, lenalidomide, and related analogs (e.g., CC-5013 and CC-4047); protein tyrosine kinase inhibitors (e.g., imatinib mesylate and gefitinib); proteasome inhibitors (e.g., bortezomib); NF-κB inhibitors, including inhibitors of IκB kinase; antibodies which bind to proteins overexpressed in cancers and thereby downregulate cell replication (e.g., trastuzumab, rituximab, cetuximab, and bevacizumab); and other inhibitors of proteins or enzymes known to be upregulated, over-expressed or activated in cancers, the inhibition of which downregulates cell replication.

In some embodiments, the antibodies of the invention can be used prior to, concurrent with, or after treatment with Velcade® (bortezomib).

All cited references are herein expressly incorporated by reference in their entirety.

Whereas particular embodiments of the invention have been described above for purposes of illustration, it will be appreciated by those skilled in the art that numerous variations of the details may be made without departing from the invention as described in the appended claims.

EXAMPLES

Examples are provided below to illustrate the present invention. These examples are not meant to constrain the present invention to any particular application or theory of operation. For all constant region positions discussed in the present invention, numbering is according to the EU index as in Kabat (Kabat et al., 1991, Sequences of Proteins of Immunological Interest, 5th Ed., United States Public Health Service, National Institutes of Health, Bethesda, entirely incorporated by reference). Those skilled in the art of antibodies will appreciate that this convention consists of nonsequential numbering in specific regions of an immunoglobulin sequence, enabling a normalized reference to conserved positions in immunoglobulin families. Accordingly, the positions of any given immunoglobulin as defined by the EU index will not necessarily correspond to its sequential sequence.

Example 1. Prototype "Triple F" Bispecific Antibody

The present invention describes novel immunoglobulin compositions that co-engage a first and second antigen. One heavy chain of the antibody contains a single chain Fv ("scFv", as defined herein) and the other heavy chain is a "regular" Fab format, comprising a variable heavy chain and a light chain (see FIG. 1). This structure is sometimes referred to herein as "triple F" format (scFv-Fab-Fc). The two chains are brought together by the dimeric Fc region (see FIG. 2). The Fc region can be modified by amino acid substitution to allow for efficient purification of the "triple F" heterodimer. Further, the Fc region can be modified by amino acid substitution to promote the formation of the "triple F" heterodimer. Examples of Fc substitutions are described more fully below.

Fc substitutions can be included in the "triple F" format to allow for efficient purification of the desired "triple F" heterodimer over the undesired dual scFv-Fc and mAb homodimers. An example of this is in the inclusion of Fc substitutions that alter the isoelectric point (pI) of each monomer so that such that each monomer has a different pI. In this case the desired "triple F" heterodimer will have a different pI than that of the undesired dual scFv-Fc and mAb homodimers, thus facilitating isoelectric purification of the "triple F" heterodimer (e.g., anionic exchange columns, cationic exchange columns). These substitutions also aid in the determination and monitoring of any contaminating dual scFv-Fc and mAb homodimers post-purification (e.g., IEF gels, cIEF, and analytical IEX columns). See FIG. 3 for a list of substitutions that can be made in Fc monomer 1 and Fc monomer 2 to allow for efficient purification of the desired "triple F" heterodimer.

Fc substitutions can be included in the "triple F" format to "skew" the formation toward the desired "triple F" heterodimer over the undesired dual scFv-Fc and mAb homodimers. For example, see FIG. 4 for a list of substitutions that can be made in Fc monomer 1 and Fc monomer 2 to "skew" production toward the "triple F" heterodimer. Amino acid substitutions listed in FIG. 3 and FIG. 4 can be combined, leading to an increased yield of "triple F" heterodimer that can be easily purified away from any contaminating dual scFv-Fc and mAb homodimers.

After optimization of an scFv domain for inclusion in the "triple F" format, an optimized scFv domain can be coupled with a variety of standard antibody heavy chains in a convenient fashion. For example, an anti-CD3 scFv for recruiting T cell cytotoxicity can be coupled with a variety of anti-tumor antigen antibody heavy chains (e.g., those binding CD5, CD20, CD30, CD40, CD33, CD38, EGFR, EpCAM, Her2, HM1.24, or other tumor antigen). Further examples of optimized scFv domains that can be conveniently coupled with standard antibody heavy chains include anti-CD 16 scFv for natural killer cell cytotoxicity; anti-CD32b scFv for inhibitory activity (here the coupled antibody heavy chain would bind, e.g., CD 19, CD40, CD79a, CD79b, or other immune receptors); and anti-transferrin receptor scFv, anti-insulin receptor, or anti-LRP1 for transport across the blood-brain barrier.

Example 2. Multi-Specific Antibodies Derived from the "Triple F" Format

Multi-specific antibodies can be constructed by attaching additional scFv or Fab domains that bind a third antigen to the C-terminus of one of the "triple F" heavy chains. See FIG. 5 for examples. Alternatively, the C-terminal scFv or Fab may bind the first or second antigen, thus conferring bivalency and an increase in overall binding affinity for that antigen.

Multi-specific antibodies can also be constructed by coupling the scFv-Fc heavy chain of the "triple F" format may with rearranged antibody heavy chains as depicted in FIG. 6. Such rearranged heavy chains may include an additional Fv region that binds a third antigen or an additional Fv region that binds the first antigen or second antigen, thus conferring bivalency and an increase in overall binding affinity for that antigen.

Example 3. Anti-CD19 Fab×Anti-CD3 scFv "Triple F" Bispecific

Amino acid sequences for anti-CD19 Fab×anti-CD3 scFv "triple F" bispecifics are listed in the figures. Amino acid substitutions made to allow for efficient purification of the desired "triple F" heterodimer over the undesired dual scFv-Fc and mAb homodimers are underlined. Amino acid sequences for preferred humanized anti-CD3 variable regions are listed in FIGS. 2 and 6 (with CDRs underlined). Some examples of expression and purification of the desired "triple F" species and its bioactivity are given below.

The production of XENP11874, a "triple F" bispecific with an anti-CD 19 Fab and anti-CD3 scFv, is outlined in FIG. 9. In FIG. 9A, the ion exchange purification of the desired "triple F" heterodimer from the undesired dual scFv-Fc and mAb homodimers is shown. The purity of the "triple F" fraction was checked by IEF gel, (data shown in FIG. 9B of U.S. Ser. No. 61/818,410, all figures and legends of which are expressly incorporated by reference). Finally, SEC was used to confirm the homogenous size of the "triple F" product (data shown in FIG. 9C of U.S. Ser. No. 61/818,410, expressly incorporated by reference).

XENP11874, anti-CD19 Fab×anti-CD3 scFv "triple F" bispecific, was shown to have potent bioactivity. The ability of XENP11874 to potently recruit T cells for B cell depletion is shown in FIG. 10 of U.S. Ser. No. 61/818,410, expressly incorporated by reference).

The production of XENP11924, a "triple F" bispecific with an anti-CD 19 Fab and anti-CD3 scFv, is outlined in FIG. 11 of U.S. Ser. No. 61/818,410, expressly incorporated by reference. In FIG. 11A of U.S. Ser. No. 61/818,410, the ion exchange purification of the desired "triple F" heterodimer from the undesired dual scFv-Fc and mAb homodimers is shown. The purity of the "triple F" fraction was checked by IEF gel, shown in FIG. 11B (of U.S. Ser. No. 61/818, 410). Finally, SEC was used to confirm the homogenous size of the "triple F" product (see FIG. 11C of U.S. Ser. No. 61/818,410).

XENP11924, anti-CD19 Fab×anti-CD3 scFv "triple F" bispecific, was shown to have potent bioactivity. The ability of XENP11924 to potently recruit T cells for the killing of the Raji tumor cell line is shown in FIG. 12 of U.S. Ser. No. 61/818,410.

Example 4. Anti-CD38 Fab×Anti-CD3 scFv "Triple F" Bispecific

Amino acid sequences for anti-CD38 Fab×anti-CD3 scFv "triple F" bispecifics are listed in FIG. 13 of U.S. Ser. No. 61/818,410. Amino acid substitutions made to allow for efficient purification of the desired "triple F" heterodimer over the undesired dual scFv-Fc and mAb homodimers are underlined. Some examples of expression and purification of the desired "triple F" species and its bioactivity are given below.

Figure 14:
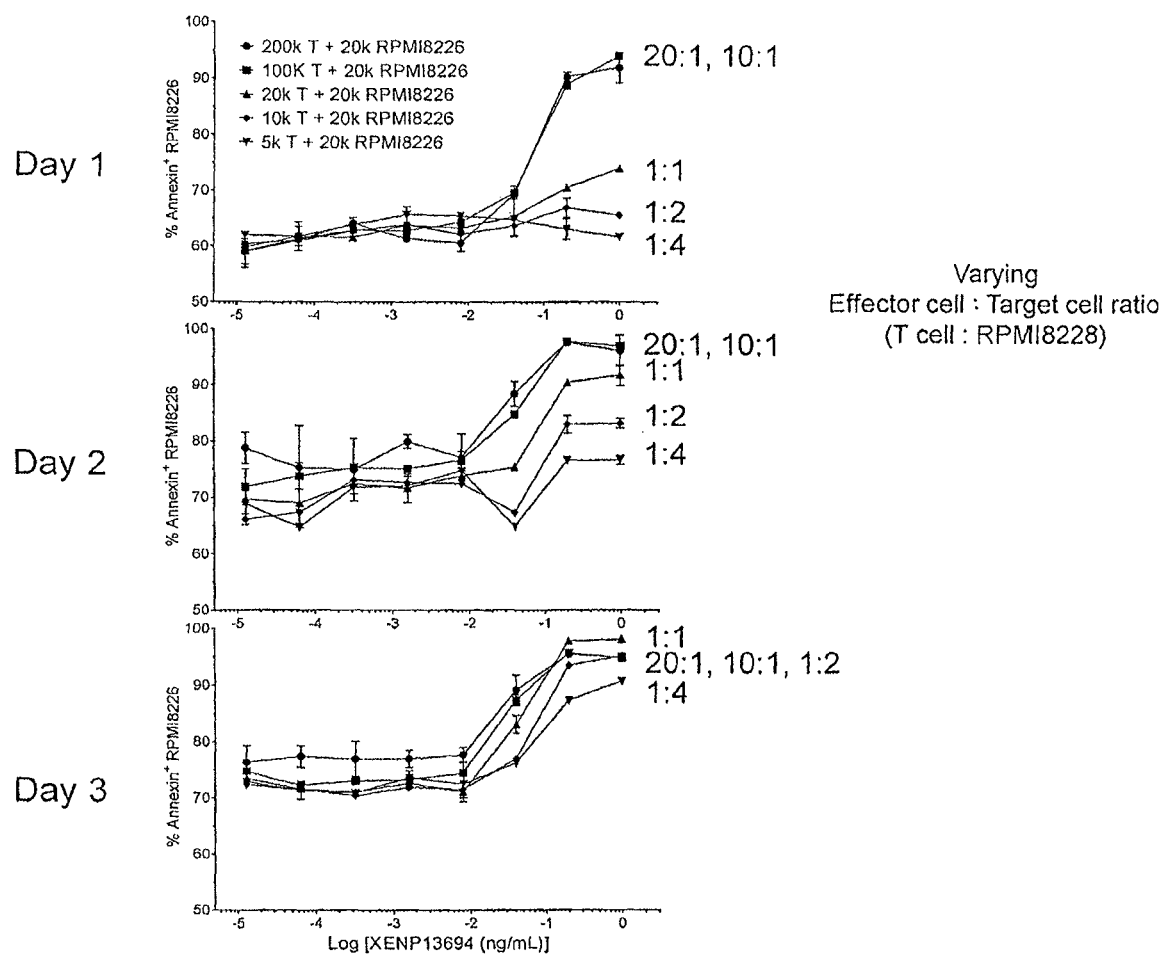
FIG. 14. RTCC assay (Annexin V+) assay showing killing of RPMI8226 multiple myeloma cells by Anti-CD38×Anti-CD3 bispecific molecules. The ratio of T-cell to RPMI8226 cells and the incubation time is varied.

The production of XENP11925, a "triple F" bispecific with an anti-CD38 Fab and anti-CD3 scFv, is outlined in FIG. 14 of U.S. Ser. No. 61/818,410. In FIG. 14A of U.S. Ser. No. 61/818,410, the ion exchange purification of the desired "triple F" heterodimer from the undesired dual scFv-Fc and mAb homodimers is shown. The purity of the "triple F" fraction was checked by IEF gel, shown in FIG. 14B of U.S. Ser. No. 61/818,410. Finally, SEC was used to confirm the homogenous size of the "triple F" product (see FIG. 14C of U.S. Ser. No. 61/818,410).

XENP11925, anti-CD38 Fab×anti-CD3 scFv "triple F" bispecific, was shown to have potent bioactivity. The ability of XENP11925 to potently recruit T cells for the killing of the RPMI8226 tumor cell line is shown in FIG. 15 of U.S. Ser. No. 61/818,410.

Example 5. Identification and Repair of Destabilizing pI-Altering Isotypic Constant Region Variants As described above, efforts can be made to minimize the risk that substitutions that increase or decrease pI will elicit immunogenicity by utilizing the isotypic differences between the IgG subclasses (IgG1, IgG2, IgG3, and IgG4). A new set of novel isotypes was designed based on this principle. These new variants are called ISO(−), ISO(+), and ISO(+RR). The thermal stability of these novel isotypes were determined in a Hinge-CH2-CH3 (H-CH2-CH3) system (Fc region only). Proteins were expressed and purified as described above. Sequences for this proof-of-concept system are listed in FIG. 16.

Figure 16:
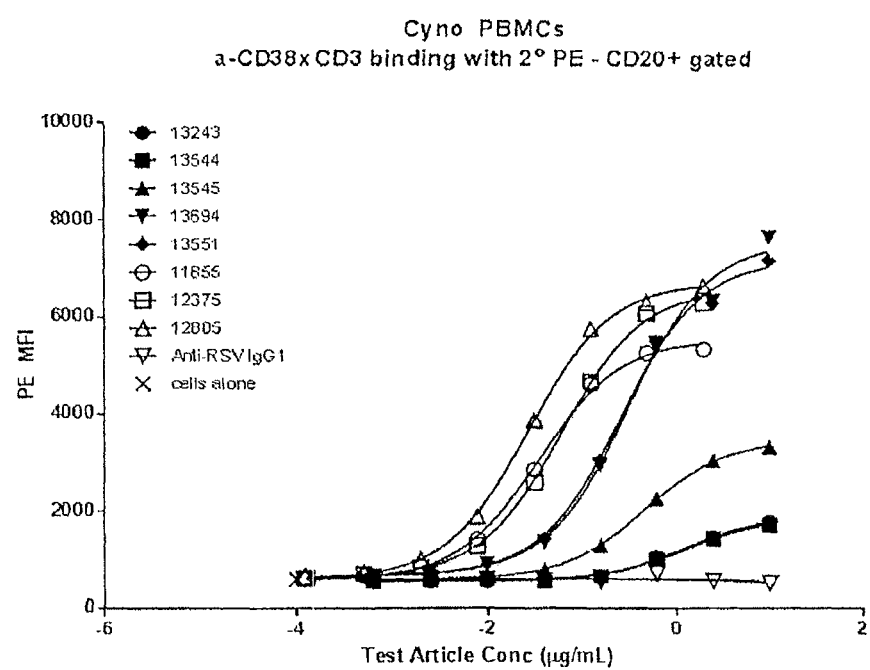
FIG. 16. Binding of Anti-CD38×Anti-CD3 bispecific molecules to cynomolgus monkey (*Macaca fascicularis*) CD20+ cells.
Figure 17:
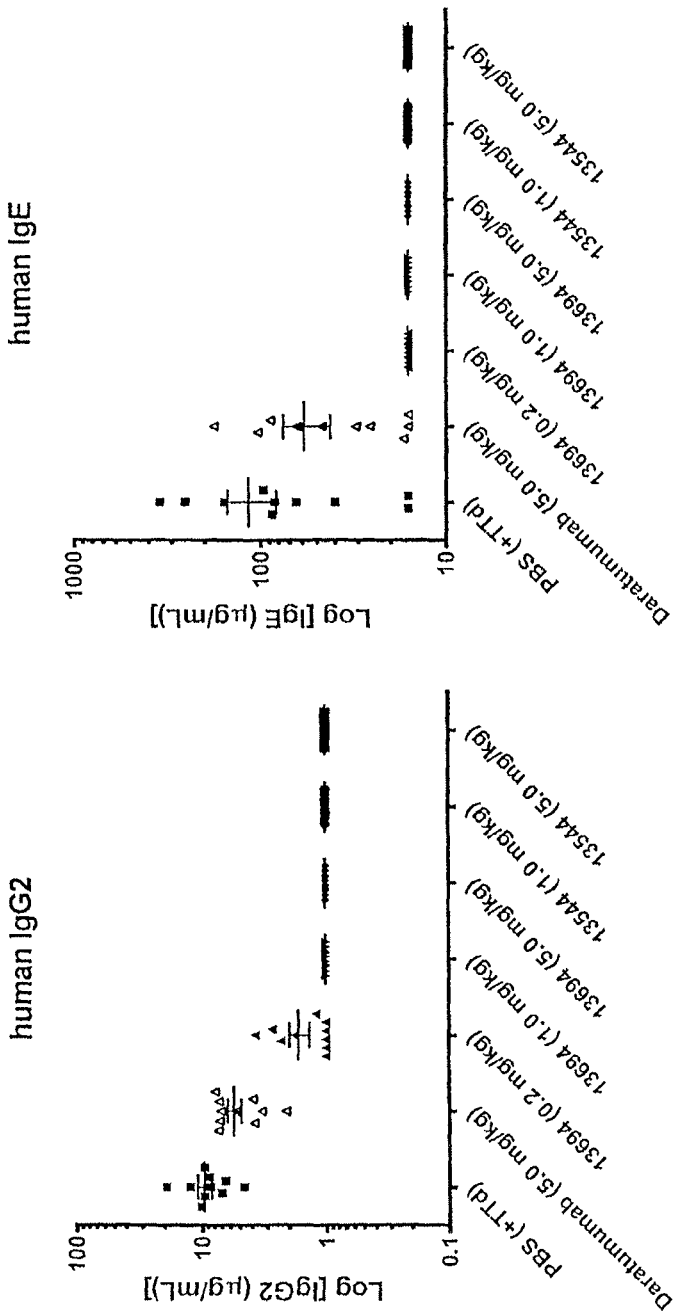
FIG. 17. Human plasma cell killing by Anti-CD38×Anti-CD3 bispecifics in huPBMC-engrafted SCID mice. Significant reductions in human IgG2 and IgE isotypes are seen. Mean±SEM for Day 22 are shown. BLQ for IgG2 is <1 µg/mL and for IgE is <16 ng/mL. Datapoints less than BLQ were assigned the BLQ value.

Thermal stability measurements (FIG. 17) determined by differential scanning calorimetry (DSC) revealed that the ISO(−)/ISO(+RR) heterodimer (XENP12488, see FIG. 16 for sequence) was less stable than wild-type IgG1 (XENP8156, see FIG. 16 for sequence). Subsequent engineering efforts identified substitutions N384S/K392N/M397V in the ISO(−) heavy chain as the source of the destabilization. As a result, the variant designated ISO(−NKV) was designed and tested (see FIG. 16). In this variant, positions 384, 392, and 397 were reverted to wild-type IgG1 (S384N/N392K/M397V). The thermal stability of the ISO (−NKV)/ISO(+RR) heterodimer (XENP12757, see FIG. 16 for sequence) was measured by DSC and found to be equivalent to that of wild-type IgG1 (FIG. 17). This result underscores the importance of choosing or not choosing particular pI-altering isotypic substitutions to avoid those that are destabilizing.

Example 6. Additional Heterodimer-Skewing Fc Variants

Figure 18:
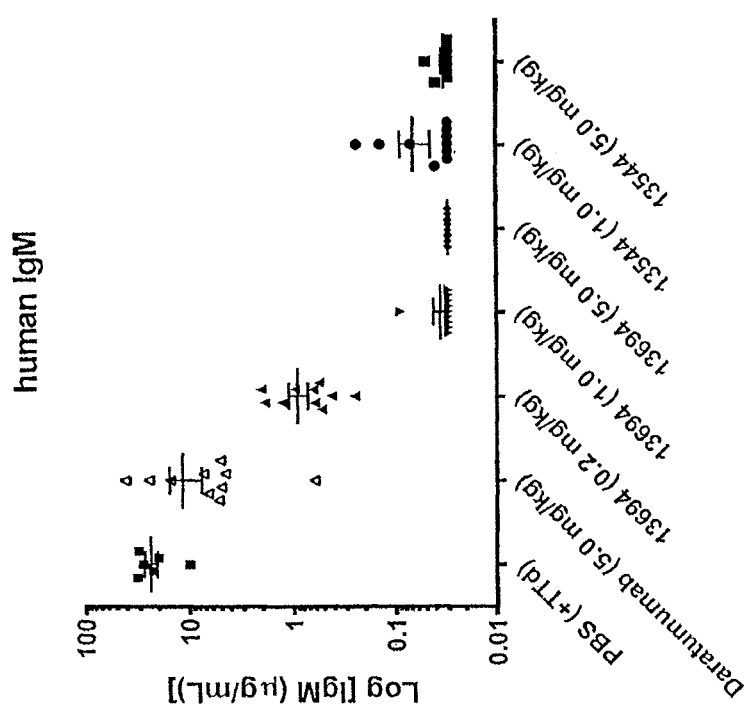
FIG. 18. Human plasma cell killing by Anti-CD38×Anti-CD3 bispecifics in huPBMC-engrafted SCID mice. Significant reduction in human IgM is seen. Mean±SEM for Day 22 are shown. BLQ for IgM is <0.03 µg/mL. Datapoints less than BLQ were assigned the BLQ value.

As described above, heterodimer-skewing Fc variants can be made to bias toward the formation of the desired heterodimer versus the undesired homodimers. Additional heterodimer-skewing Fc variants L368D/K370S-S364K/E357Q (XENP12760, see FIG. 18 for sequence) were designed and tested in a Hinge-CH2-CH3 system (Fc region only). Protein was expressed and purified as described above.

Figure 19:
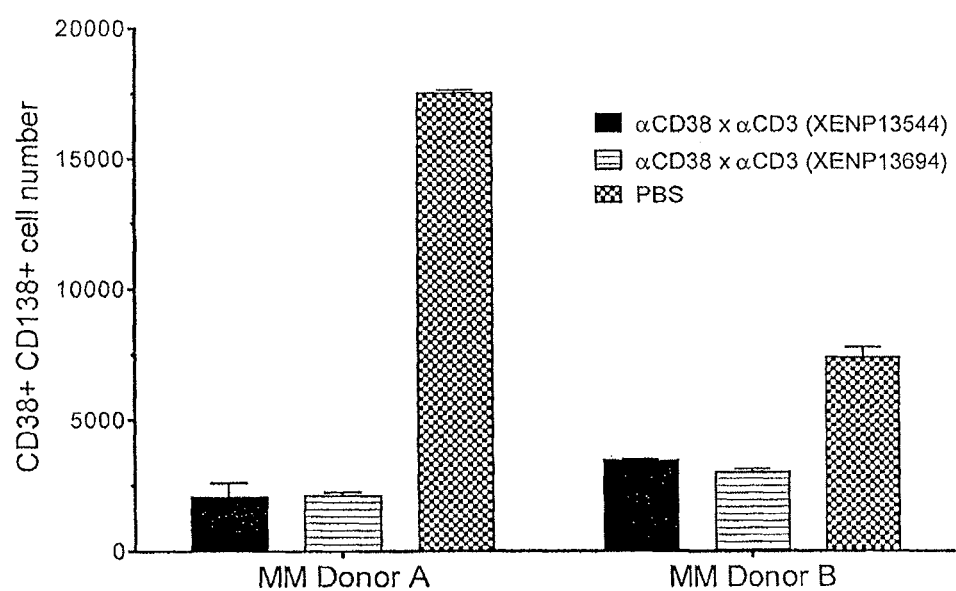
FIG. 19. CD38+CD138+ cell depletion in MM PBMC by Anti-CD38×Anti-CD3 bispecific antibodies.
Figure 25A:
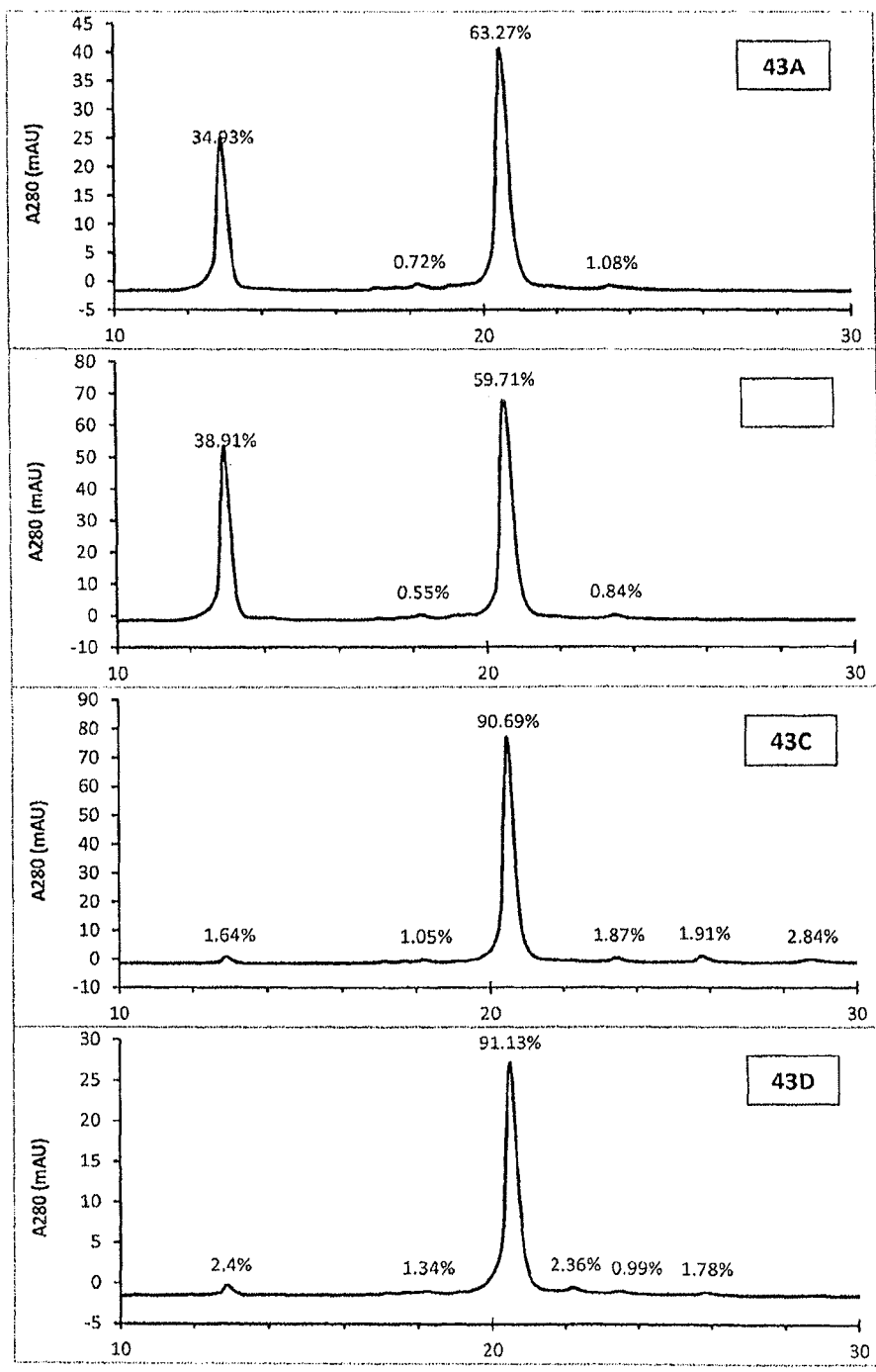
FIGS. 25A, 25B, 25C and 25D depict cation exchange chromatograms of protein A purified material from stable pool supernatants collected after 7 days of batch culture for XENP13243 and XENP13551. DNA transfection ratios are as listed in FIG. 24. Integrated peak areas are noted.
Figure 25B:
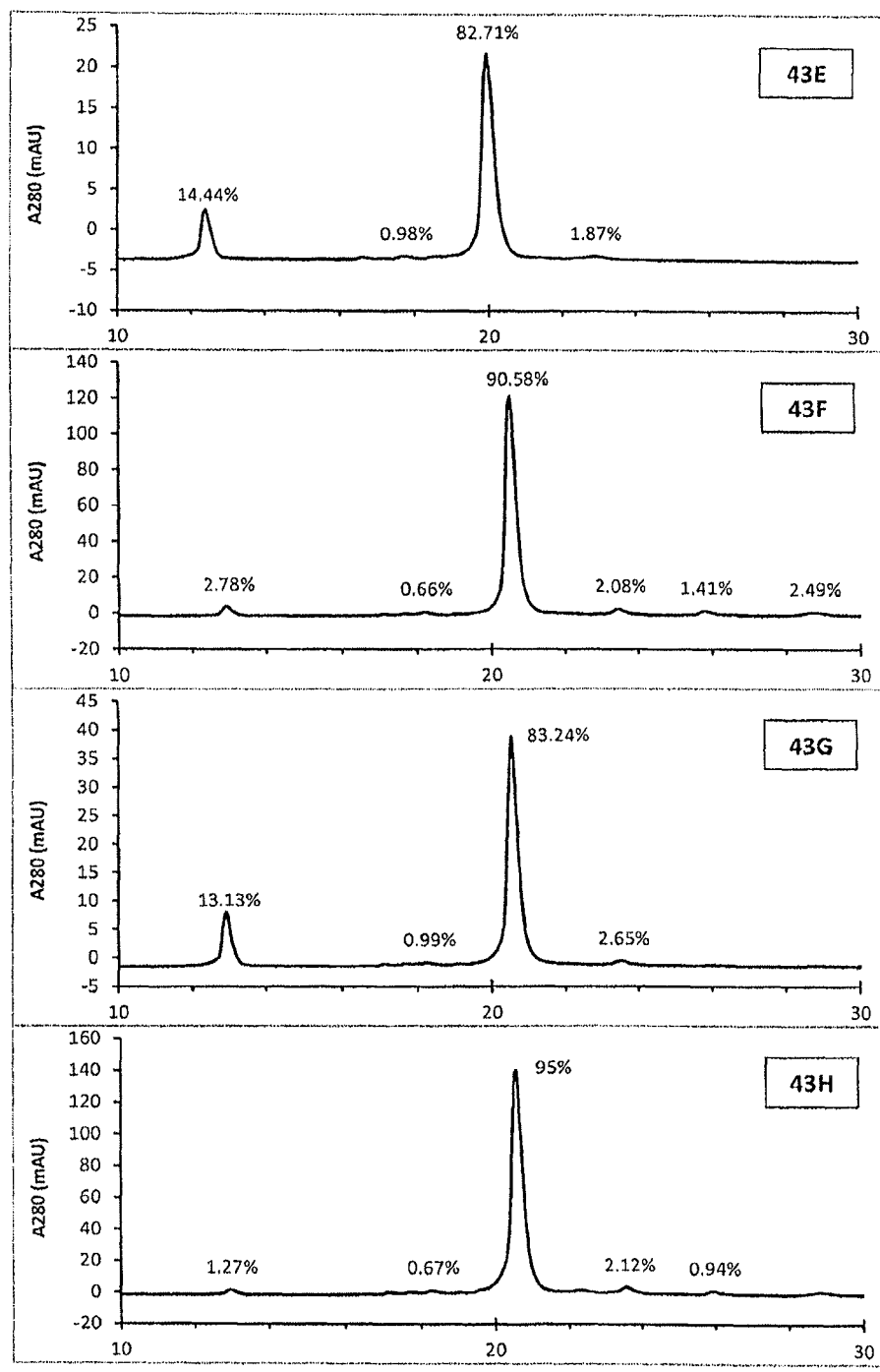
Figure 25C:
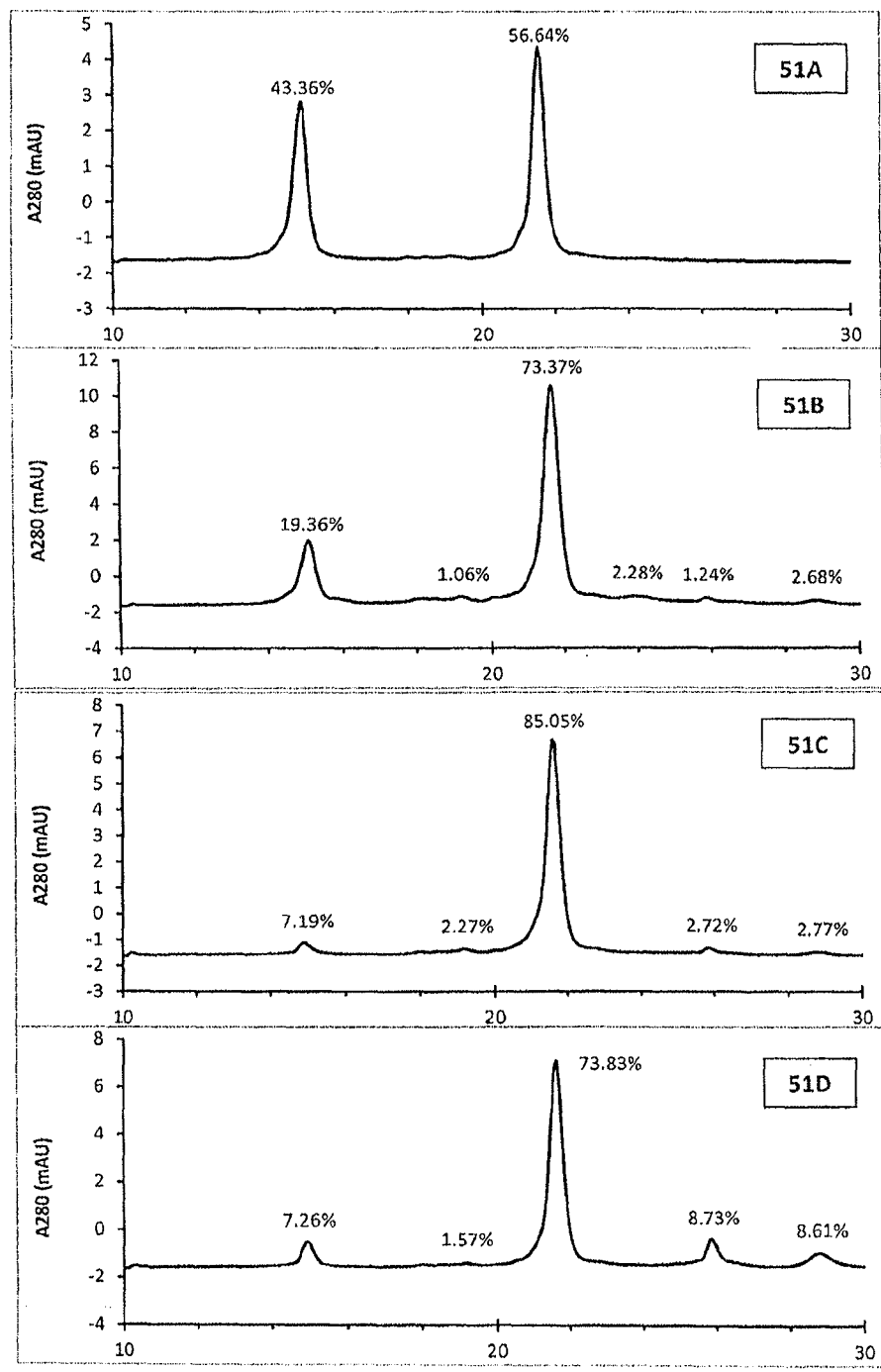
Figure 25D:
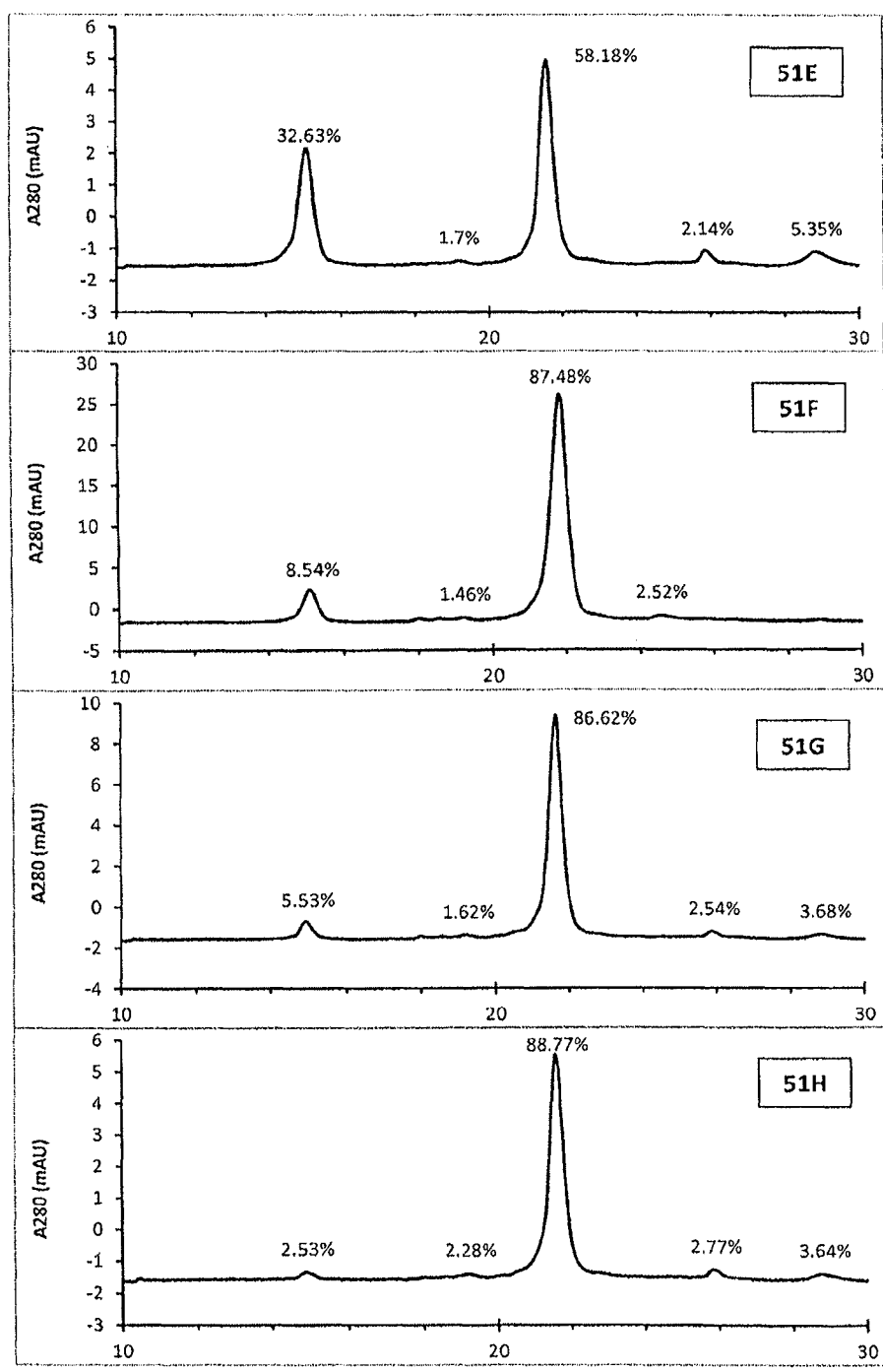
Figure 27:
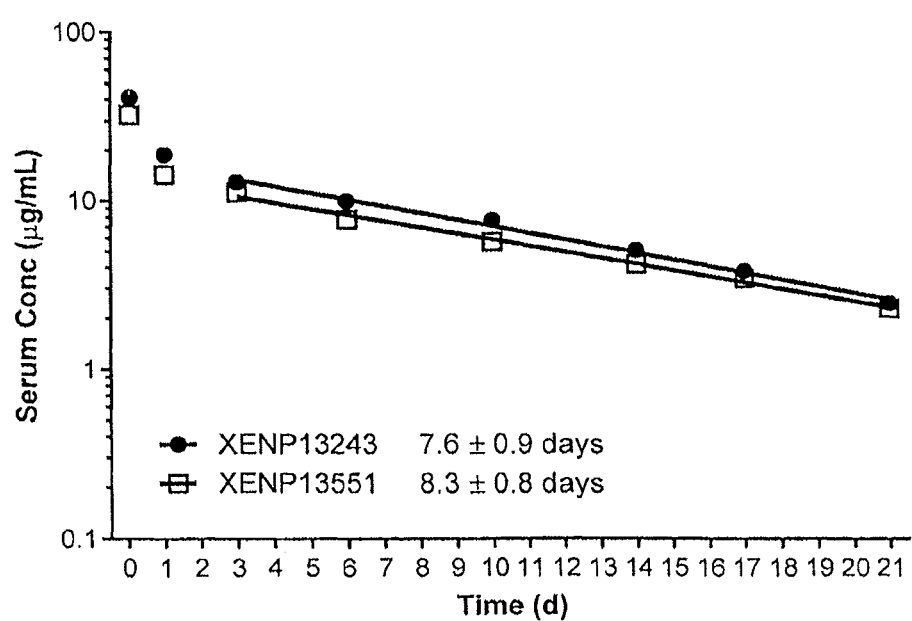
FIG. 27. Pharmacokinetics of anti-CD38×anti-CD3 bispecifics XENP13243 and XENP13551 in C57BL/6 mice (n=5 mice per group). Half-life values calculated by non-compartmental analysis are noted in the figure legend.
Figure 28:
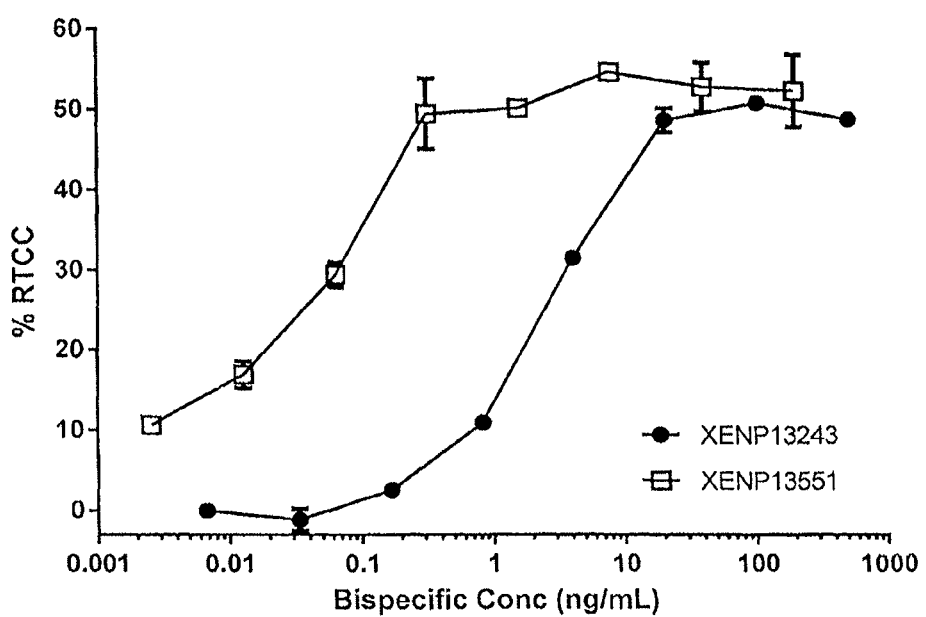
FIG. 28. Redirected T cell cytotoxicity of CD38+ RPMI8226 cells. Assay consisted of a 24 h incubation at 37° C. of 10,000 RPMI8226 cells with 400,000 purified human T cells. Readout of cytotoxicity was by lactate dehydrogenase (LDH).
Figure 30:
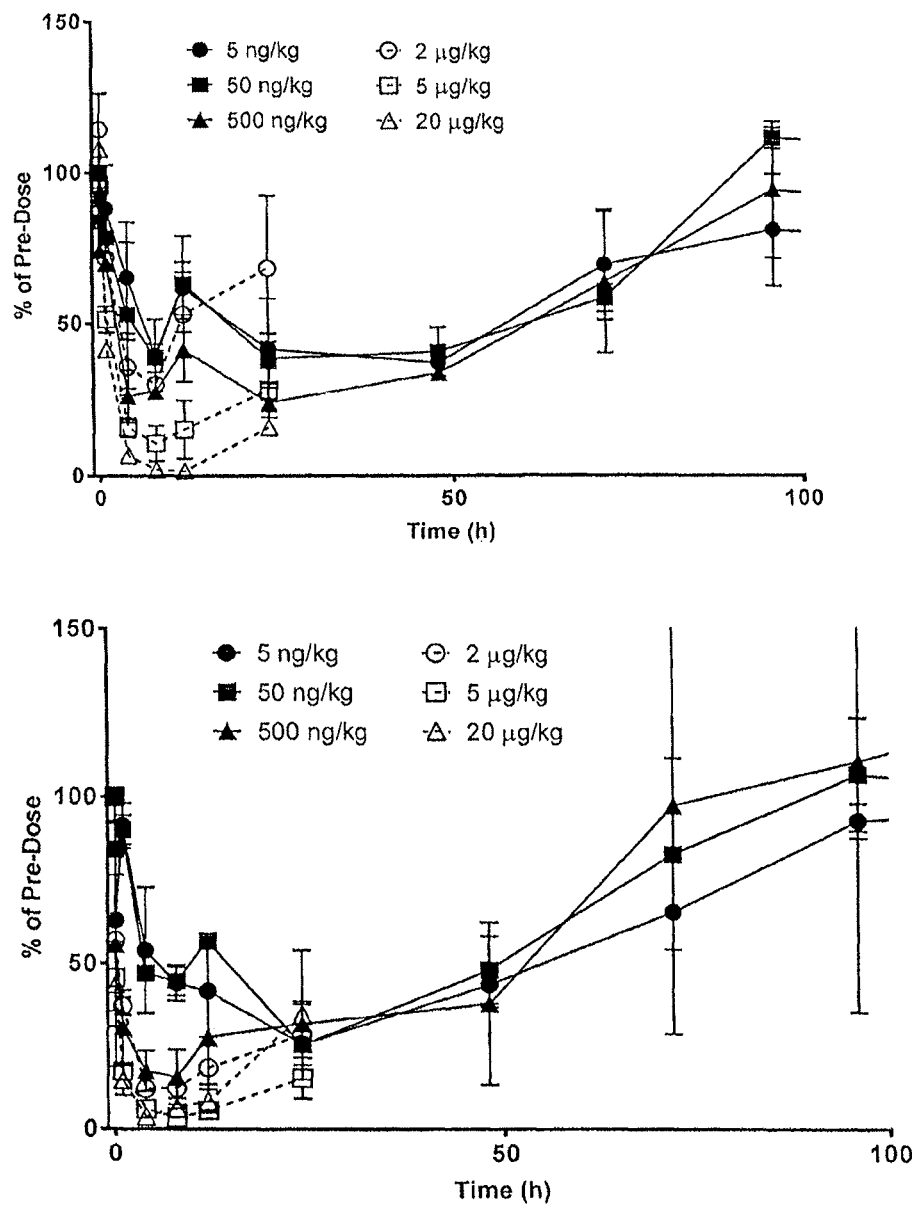
FIG. 30 Depletion of CD20-CD38+ cells in cynomolgus monkeys by XENP13243 (top panel) and XENP13551 (bottom panel).
Figure 31:
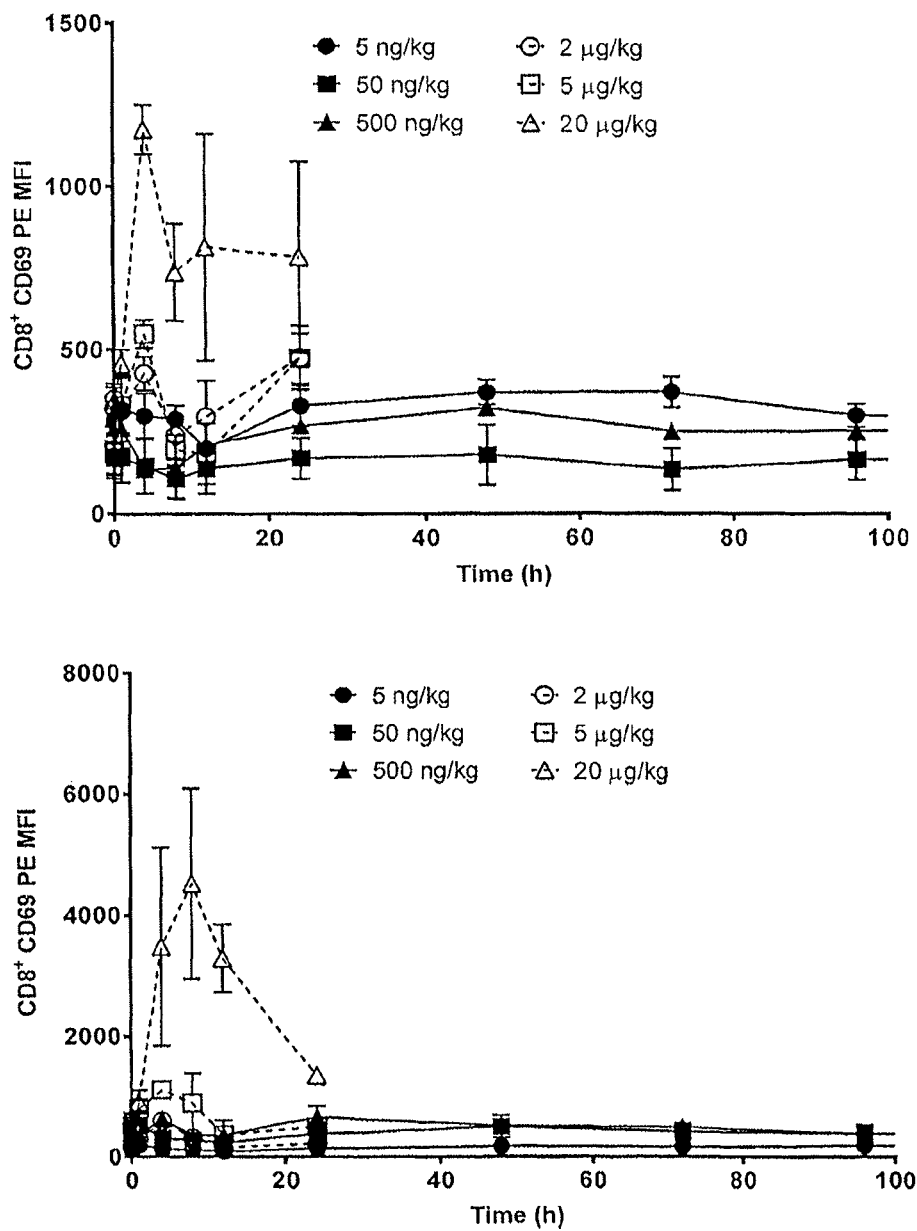
FIG. 31. Upregulation of CD69 in CD8+ T cells in cynomolgus monkeys by XENP13243 (top panel) and XENP13551 (bottom panel).

The proteins present after only a single standard protein A purification step were examined by high-performance liquid chromatography (HPLC) using a cation exchange (CIEX) column (see FIG. 19). This allowed the determination of the yield of desired heterodimer versus undesired homodimers. The presence of the L368D/K370S-S364K/E357Q variant (XENP12760, FIG. 19, bottom panel) introduced an extreme bias toward the desired formation of heterodimer compared against the absence of this variant (XENP12757, FIG. 19, top panel). Note that heterodimer yield is 95.8% with the L368D/K370S-S364K/E357Q variant versus only 52.7% without.

Additional heterodimer-skewing Fc variants were also designed and tested. FIG. 36 provides a list of engineered heterodimer-skewing Fc variants with heterodimer yields (determined by HPLC-CIEX) and thermal stabilities (determined by DSC). The L368D/K370S-S364K/E357Q variant with high heterodimer yield and high thermal stability is especially preferred.

Example 7. Additional Heterodimer-Skewing Fc Variants in the Fab-scFv-Fc Context Heterodimer-skewing Fc variants L368D/K370S-S364K/E357Q were engineered into an anti-CD19×anti-CD3 Fab-scFv-Fc (see FIG. 15 for amino acid sequences). Control Fab-scFv-Fc XENP13228 lacked these heterodimer-skewing Fc variants. The proteins present after only a single standard protein A purification step were examined by an isoelectric focusing (IEF) gel. This allowed the determination of the yield of desired heterodimer versus undesired homodimers. The presence of the L368D/K370S-S364K/E357Q variant (XENP13122, FIG. 22, right lane) introduced an extreme bias toward the desired formation of heterodimer (center band) compared against the absence of this variant (XENP13228, FIG. 22, left lane).

Example 7. Constructing Anti-CD38×Anti-CD3 Bispecific Antibodies

Figure 38:
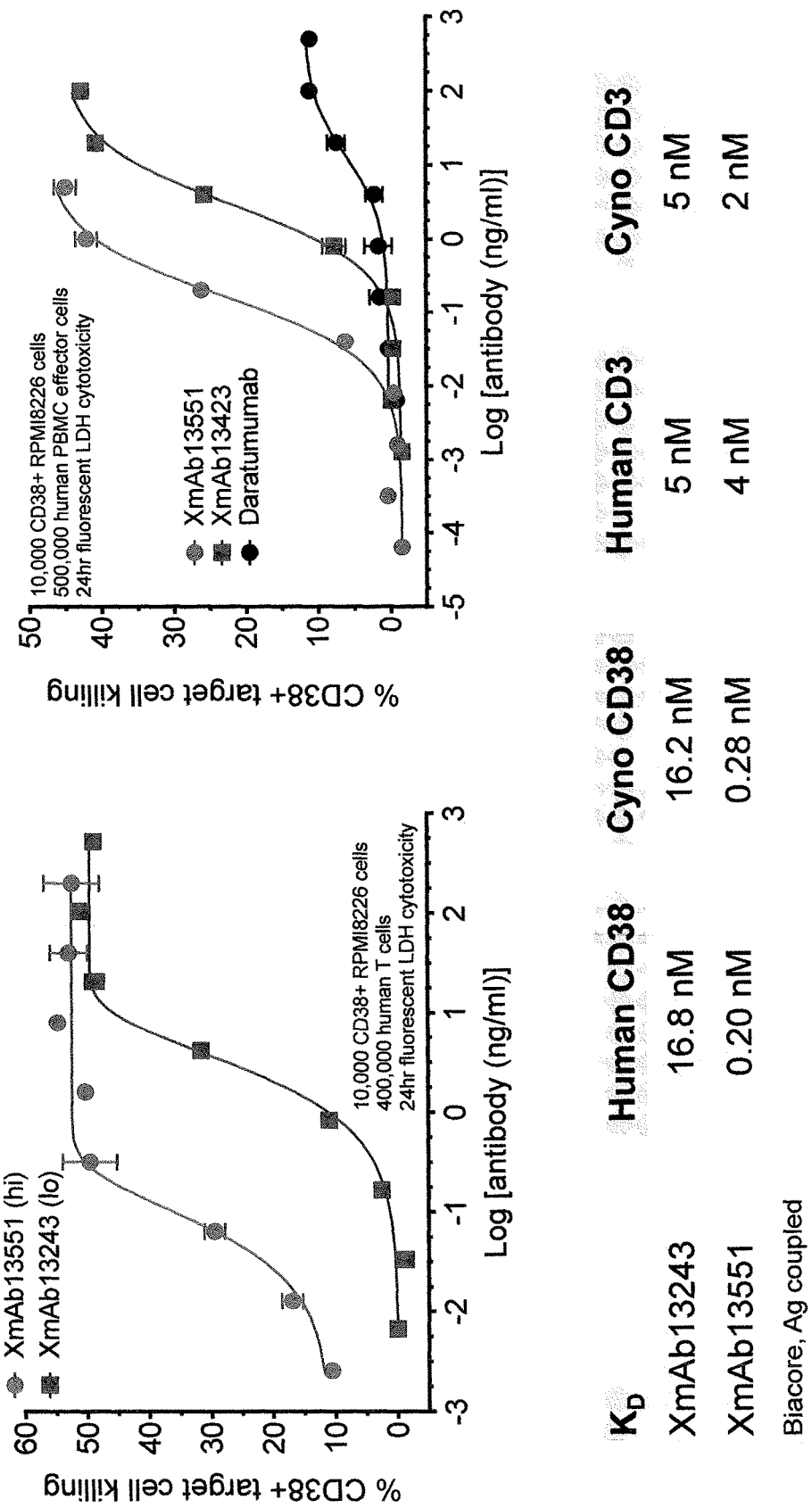
FIG. 38 depicts the killing of a human myeloma cell line. XmAb13551 has high affinity for CD3, while XmAb13243 has lower affinity. Daratumumab is a anti-CD38 bivalent monospecific antibody.

The anti-CD38 antibody OKT10 was humanized by optimization of human string content (Lazar et al., Mol. Immunol., (2007), 44: 1986-1998), and a bispecific molecule containing the humanized anti-CD38 Fv and an anti-CD3 domain was created (FIG. 37). Desired gene segments were synthesized by Blue Heron Biotechnologies (Bothell, Wash.) from synthetic oligonucleotides and PCR products by automated gene synthesis. Antibody constructs in the pTT5 vector were expressed in 293E cells and purified by standard Protein A, followed by IEX chromatography using a GE HiTrap SP cation exchange column in order to isolate the desired heterodimeric bispecific. Antibody Fc domains contained an engineered heterodimeric Fc region to facilitate efficient purification of bispecific molecules. Affinity of the bispecifics for CD38 was improved by screening a library of Fv region variants on SPR using a Biacore 3000 (FIG. 38).

Example 8. In Vitro Properties of Anti-CD38×Anti-CD3 Bispecific Antibodies

Figure 39:
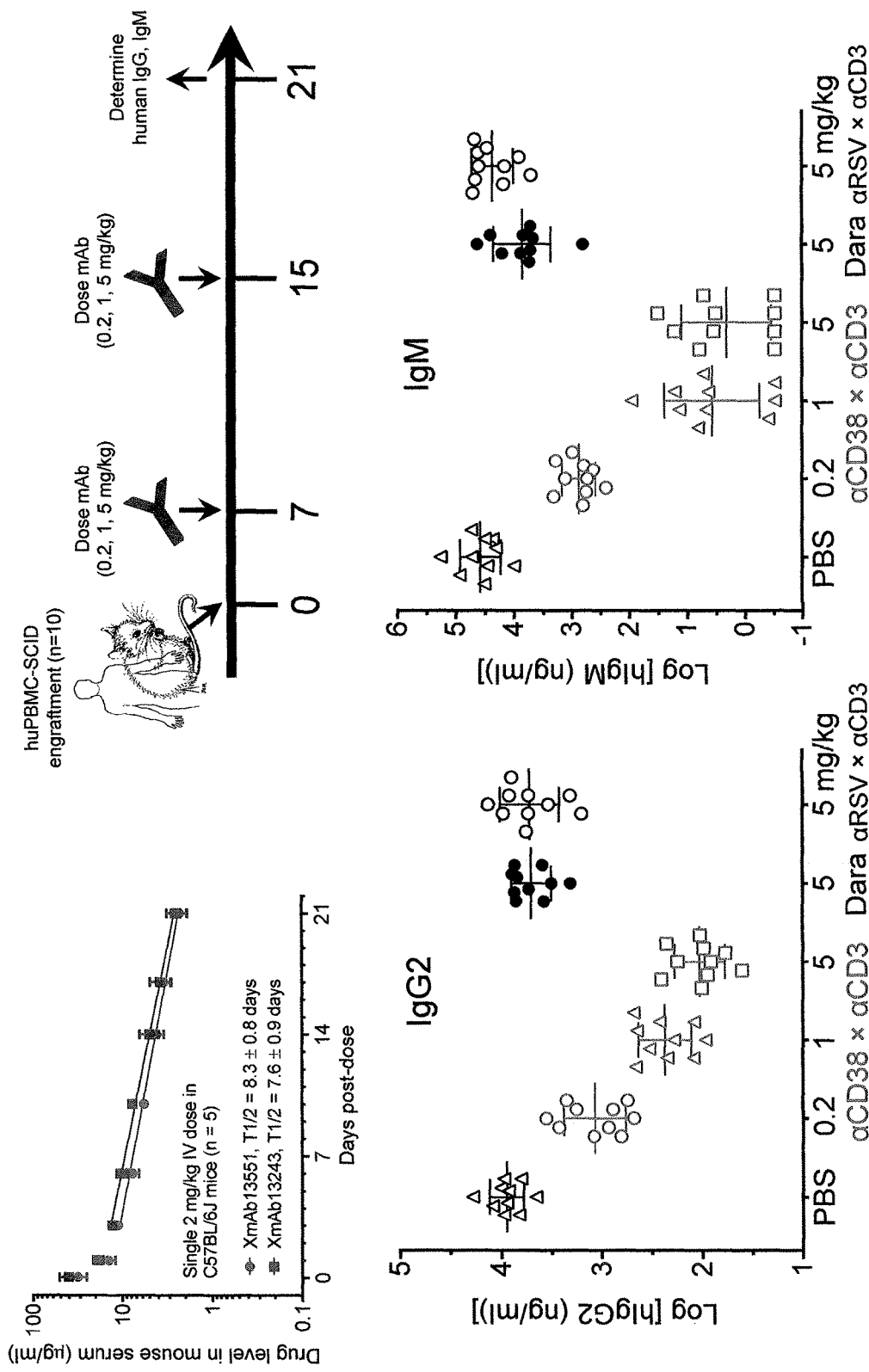
FIG. 39 shows the long half-life activity of the bottle opener bispecifics of the invention and the corresponding suppression of human Igs in mice.
Figure 40:
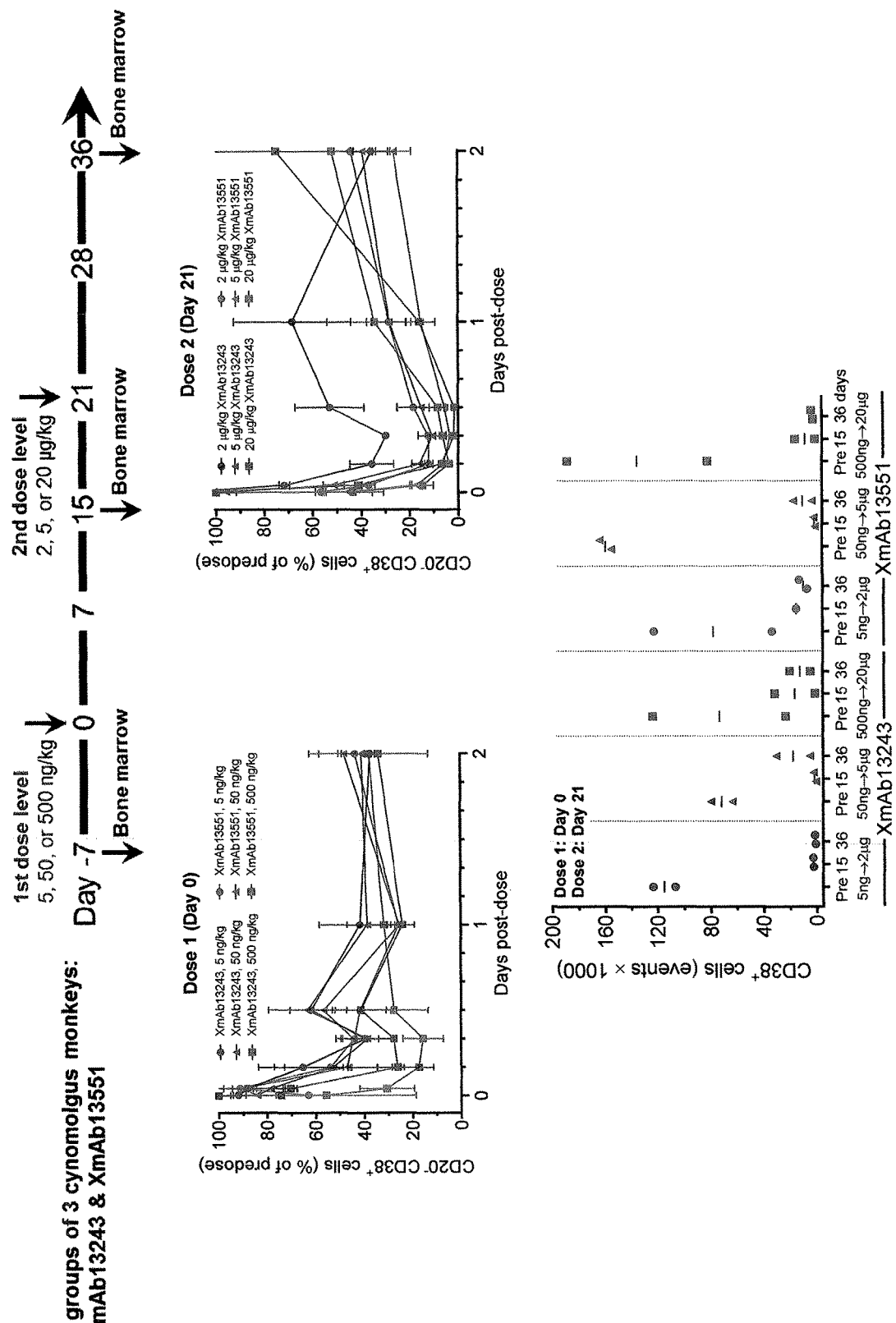
FIG. 40 shows the anti-CD38×anti-CD3 functions of XmAb13551 and XmAb13243, including the depletion of monkey CD38+ cells in blood and bone marrow.
Figure 42:
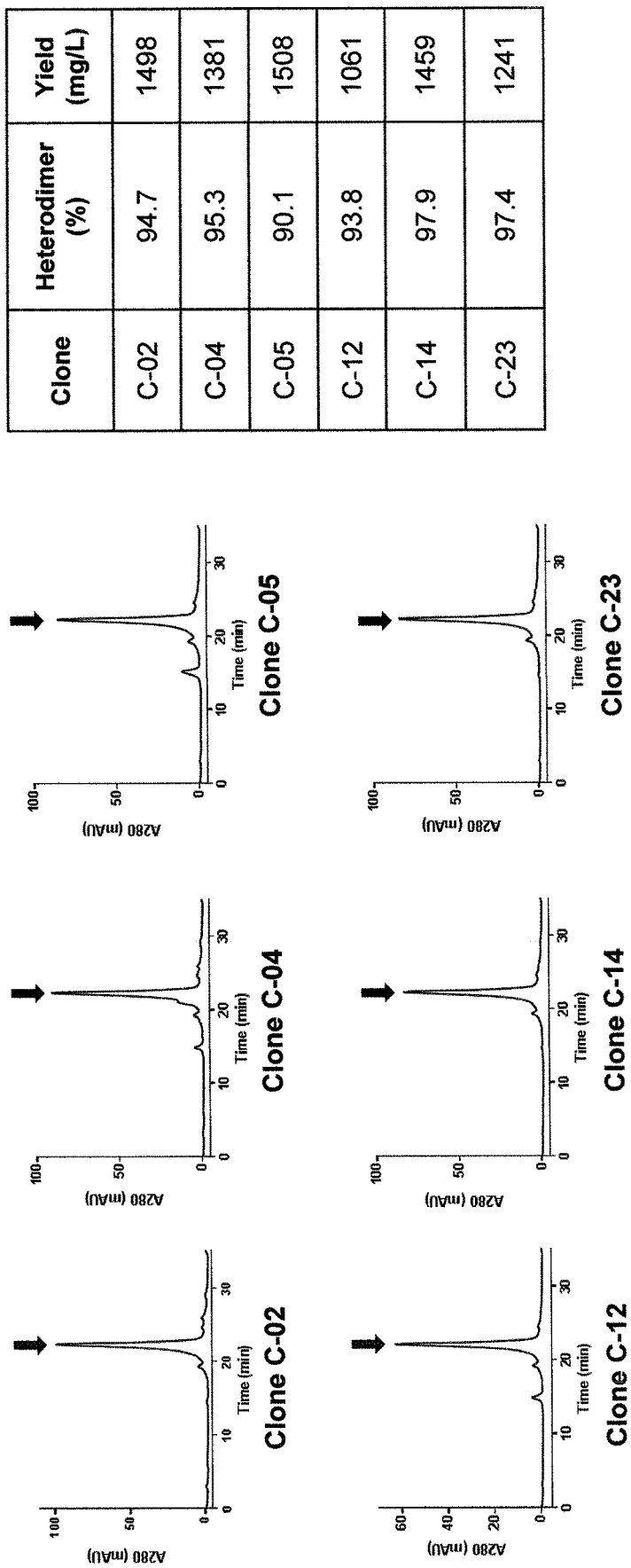
FIG. 42 shows the development of a stable cell line for production of XmAb13551 (high CD3 affinity) and their corresponding yields.

Optimized bispecific molecules were screened for their ability to kill RPMI8226 multiple myeloma (MM) cells in a LDH re-directed T-cell cytotoxicity (RTCC) assay (FIG. 39) and in an Annexin V+RTCC assay utilizing different T-cell:RPMI8226 ratios (FIG. 40). Optimized molecules were also assessed for cross reactivity to cynomolgus anti-CD38 using a direct binding assay (FIG. 41). A table summarizing various properties of the optimized Anti-CD38×Anti-CD3 bispecific molecules is shown in FIG. 42.

Example 8. Human Plasma Cell Killing by Anti-CD38×Anti-CD3 Bispecifics in huPBMC-Engrafted SCID Mice Optimized bispecific molecules were screened for their ability to kill human plasma cells in a huPBMC-engrafted SCID mouse model. Groups of 10 mice each were treated with α-ASGM1 to deplete SCID NK cells on Day 0, followed by engraftment of 3×107 human PBMCs on Day 1. Groups were randomized based on total IgG levels on Day 4. Anti-CD38×Anti-CD3 bispecific molecules or controls were dosed on Day 7 and 15 after PBMC engraftment. IgG2, IgE, and IgM titers were determined at Day 14 and 21. Daratumumab (an anti-CD38 IgG1 antibody) was included as a control at a dose of 5 mg/kg. Significant reductions in human Ig isotypes were seen with Anti-CD38×Anti-CD3 bispecific molecules compared to daratumumab. (FIGS. 43 and 44).

Example 4. CD38+CD138+ Cell Depletion in Multiple Myeloma Patient PBMC by Anti-CD38×Anti-CD3 Bispecific Antibodies PBMC from two MM donors were incubated with 1 μg/mL Anti-CD38×Anti-CD3 bispecific molecules for 24 hours and cells counted. CD38+CD138+ cells from pre-gated live cells (sorted by FSC vs SSC) were counted and events were normalized against the PBS treated control. Results are shown in FIG. 45. Bispecifics were able to potently deplete MM cells at this concentration.

Example 5. Amino Acid and DNA Sequences for Anti-CD38×Anti-CD3 Bispecifics

Figure 51A:
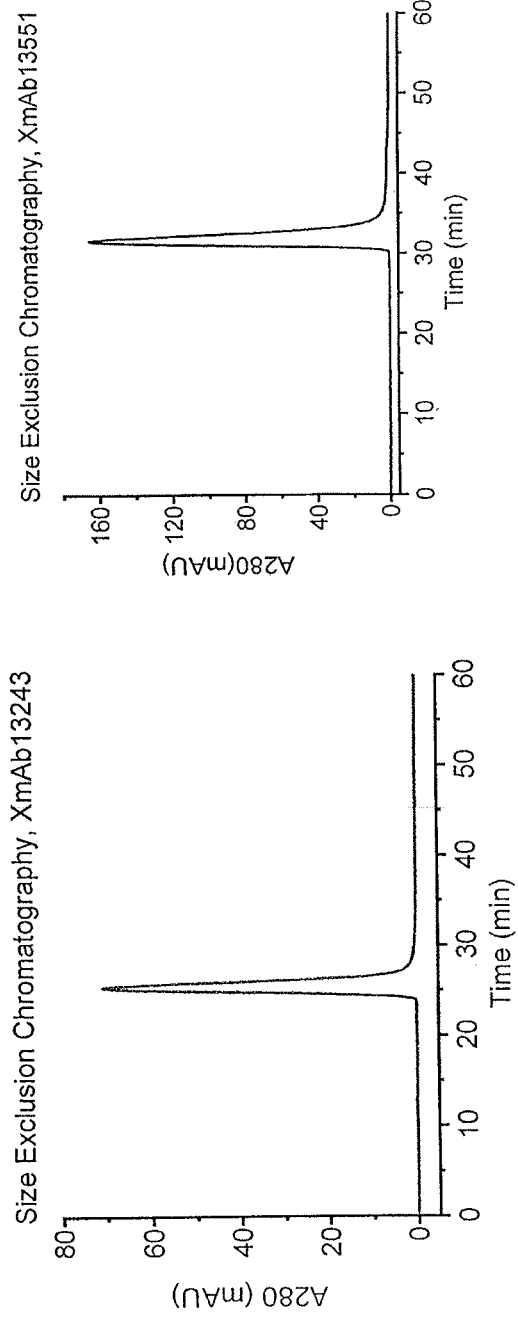
FIGS. 51A and 51B show the purification of XENP13243 & XENP13551 are designed with low & high affinity, respectively, for CD38.
Figure 51B:
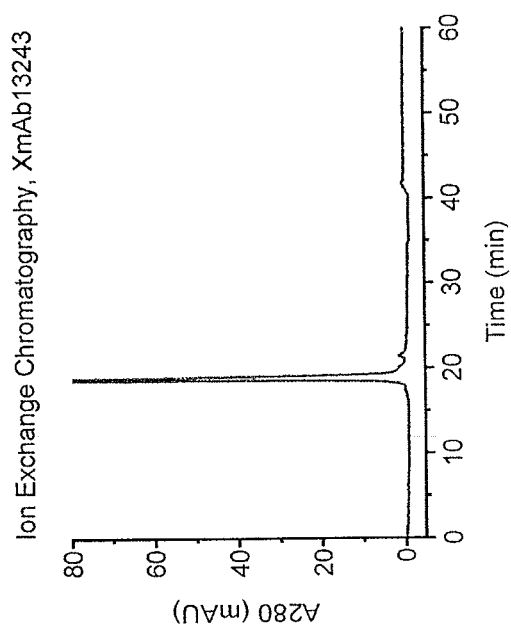

Amino acid and DNA sequences for anti-CD38×anti-CD3 bispecifics XENP13243 and XENP13551 are listed in FIGS. 50 and 51, respectively.

Figure 52A:
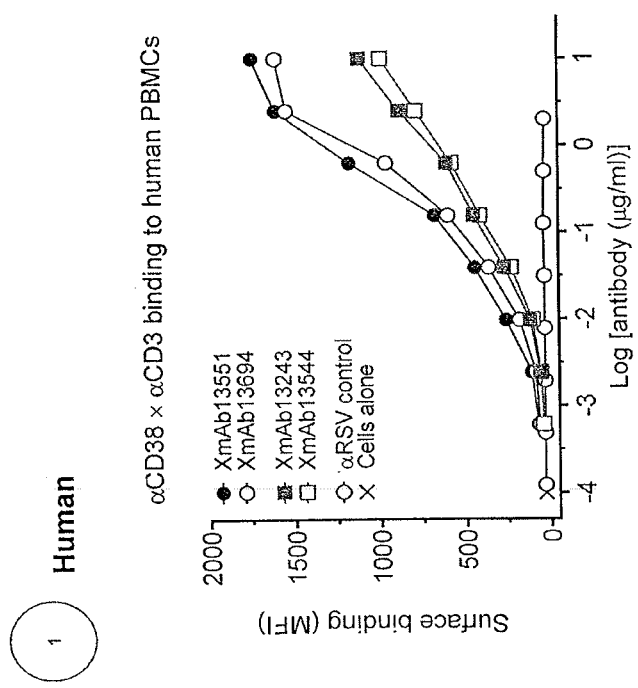
Figure 52B:
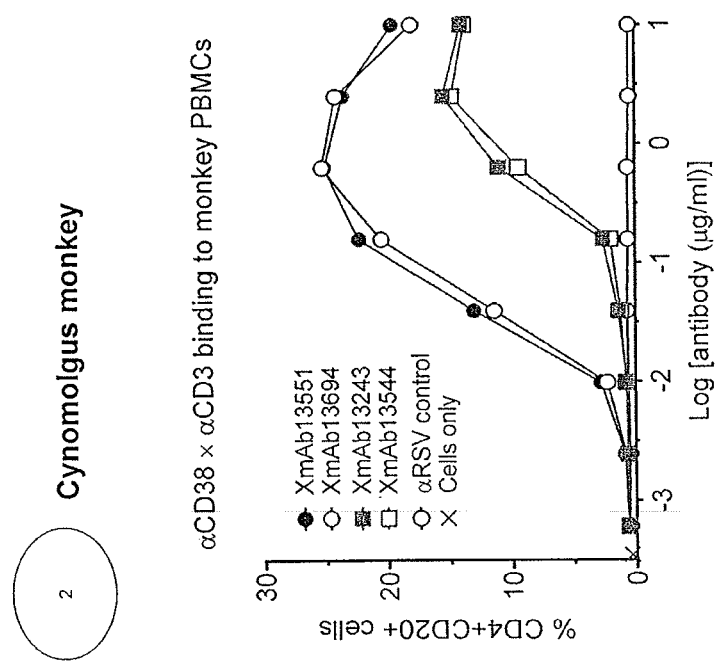
Figure 54:
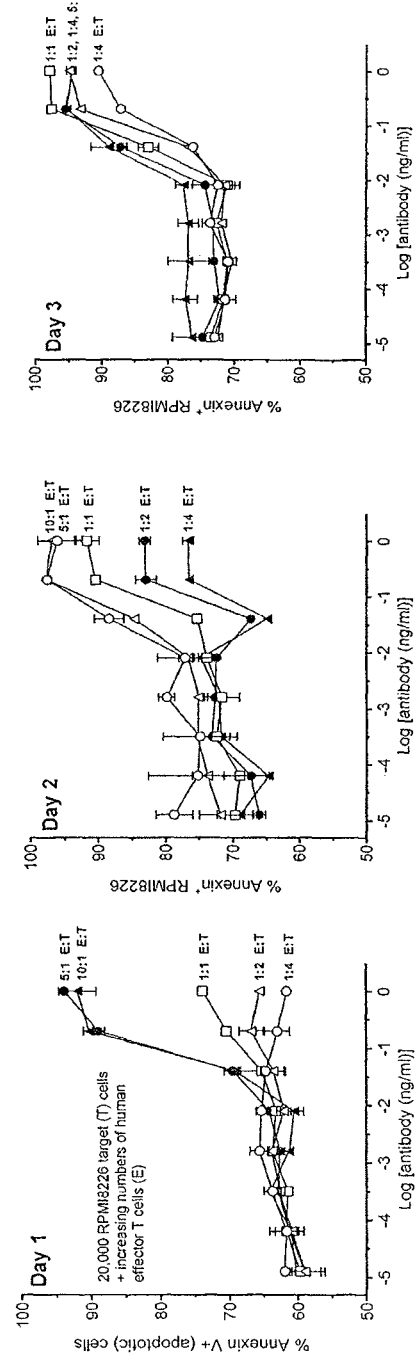
FIG. 54 shows the T cells are serial killers even when outnumbered by target cells.

Example 6. Stable Pool Generation in Chinese Hamster Ovary (CHO) Cells for Anti-CD38×Anti-CD3 Bispecifics Chinese Hamster Ovary (CHO) cells were transfected with DNA encoding XENP13243 and XENP13551 to generate parallel stable pools according to the ratios listed in FIG. 3 using Selexis's proprietary SURE Technology Platform™. Transfected DNA consisted of monocistronic vectors containing the DNA listed in FIG. 52. Stable pool cells were cultured for 7 days in 10 mL spin tubes, and on the 7th day, 5 mL of the culture supernatant was extracted, purified by protein A affinity chromatography, and analyzed by cation exchange chromatography. As the possible proteins that could be generated were designed to have different isoelectric points, cation exchange chromatography allowed for the analysis of which protein species were secreted by the CHO cells as a function of the different DNA ratios. FIG. 4 catalogues the cation exchange chromatograms for each of the specified DNA ratios listed in FIG. 3 for both XENP13243 and XENP13551. Under the conditions used for the cation exchange chromatographic analysis, HC-Fab homodimers elute at ~15 min; desired heterodimeric bispecifics elute at ~22 min; HC-scFv monomers elute at ~26 min; and HC-scFv homodimers elute at ~29 min. A summary of the amounts of the different protein species is listed in FIG. 54.

Surprisingly, heterodimer formation can be driven by transfection ratios of the three nucleic acids in a host cell (the HC-scFv, the HC and the LC). Several DNA transfection ratios provided for formation of the preferred bispecific heterodimer in amounts greater than 80% of the total protein A purified material. Preferred ratios for formation of greater than 80% heterodimer are 1:1.5:1.5, 1:2:1.5, 1:0.667:2, 1:1:2, 1:1.5:2, and 1:2:2 (all listed as HC-Fab:HC-scFv:LC). Some DNA ratios provided for formation of the preferred bispecific heterodimer in amounts greater than 90%. Preferred ratios for formation of greater than 90% heterodimer are 1:1.5:1.5, 1:2:1.5, 1:1:2, and 1:2:2 (all listed as HC-Fab:HC-scFv:LC). One DNA ratio provided for formation of the preferred bispecific heterodimer in an amount greater than 95%. An especially preferred ratio for formation of greater than 95% heterodimer is 1:2:2 (listed as HC-Fab:HC-scFv:LC).

Example 7. Pharmacokinetics of Anti-CD38×Anti-CD3 Bispecifics in C57BL/6 Mice

Figure 55:
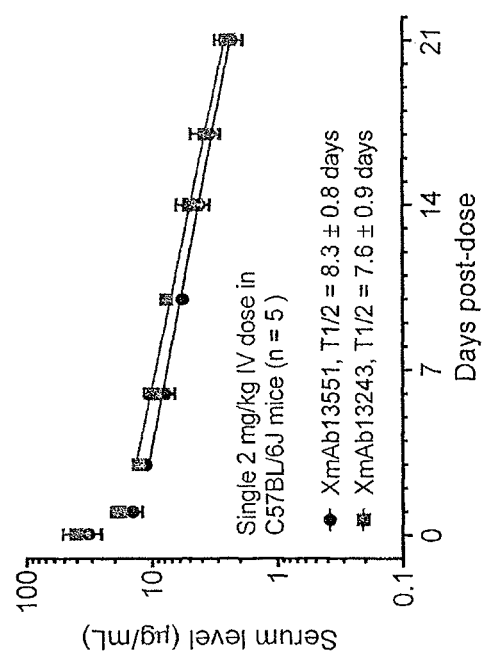
FIG. 55 shows the Fc domain prolongs the half-life.
Figure 56:
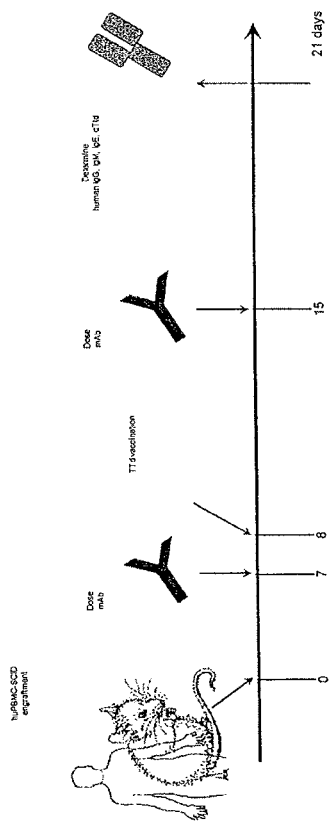
FIG. 56 shows the dosing for FIG. 14 experiment.
Figure 57:
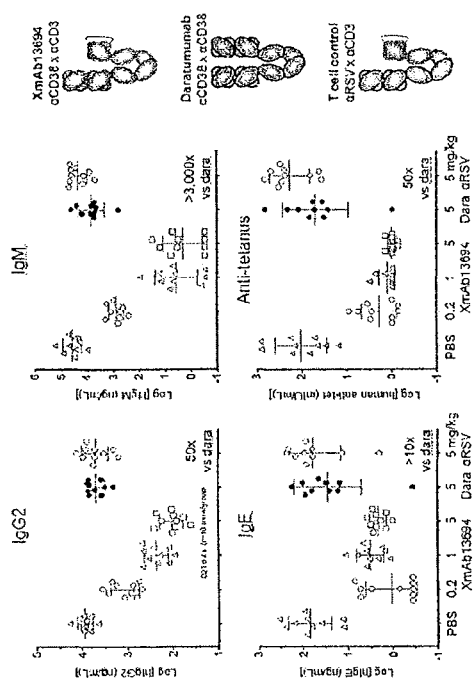
FIG. 57 shows greater hIg depletion versus daratumumab.
Figure 58:
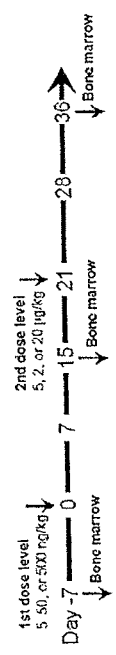
FIG. 58 shows the dosing for FIG. 16 experiment.
Figure 59A:
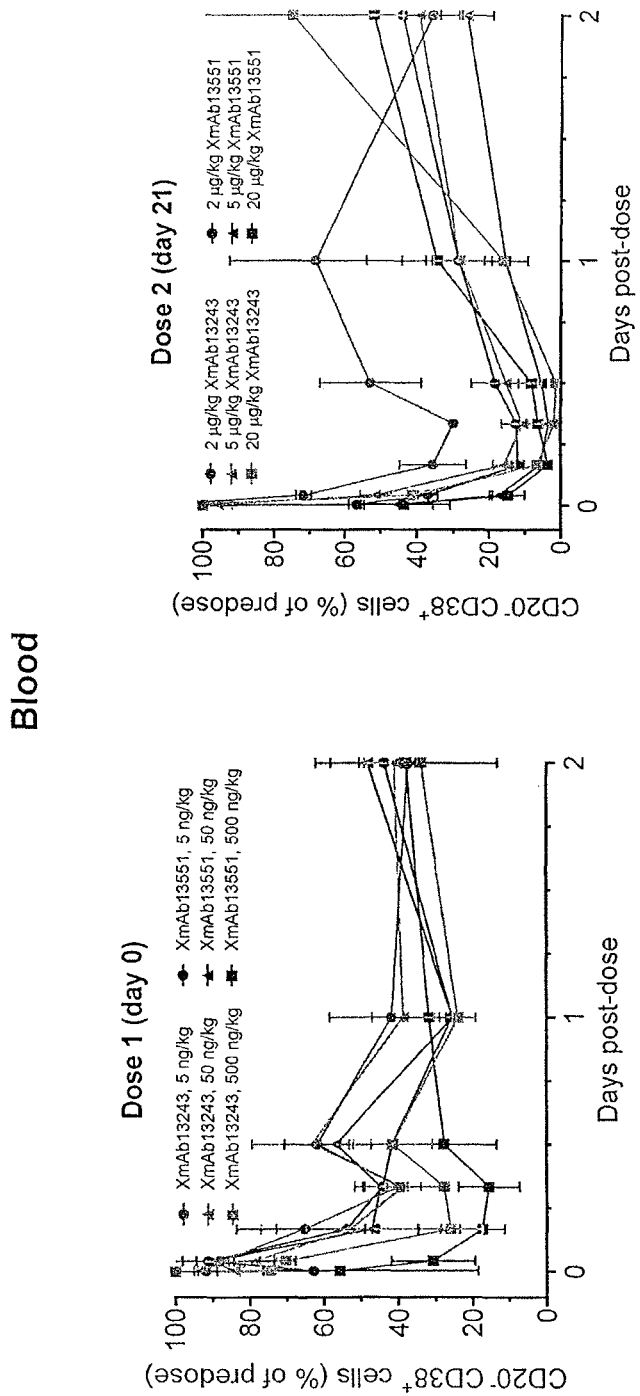
FIGS. 59A and 59B Bispecifics deplete CD38+ cells in blood & lymphoid organs in monkeys.
Figure 59B:
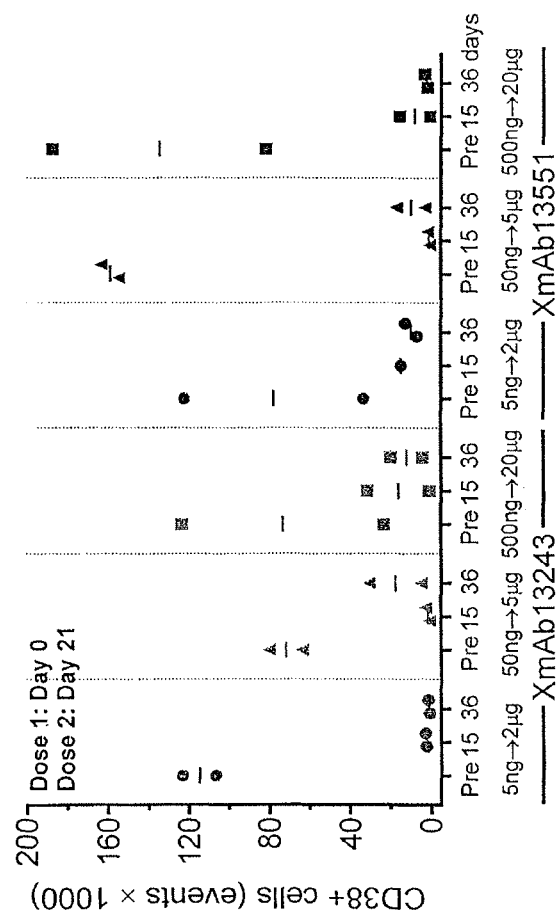
Figure 60A:
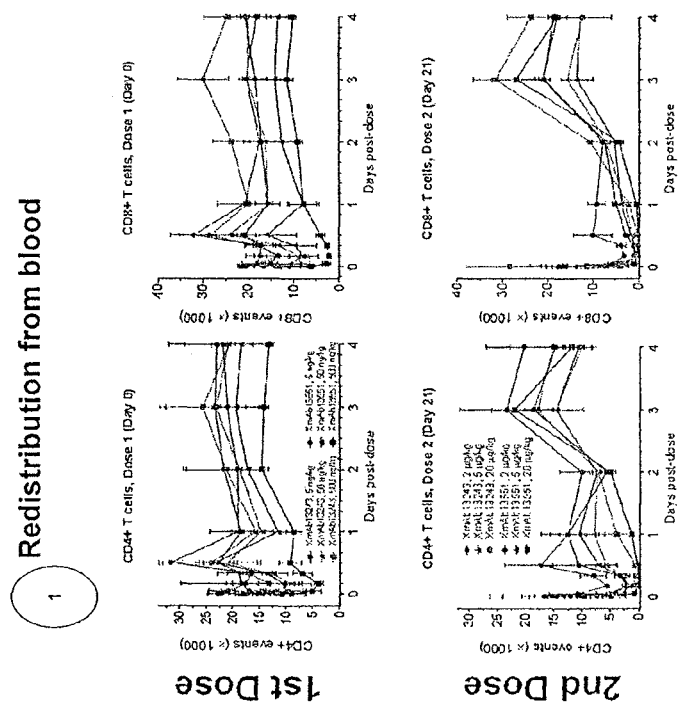
FIGS. 60A, 60B and 60C.
Figure 60B:
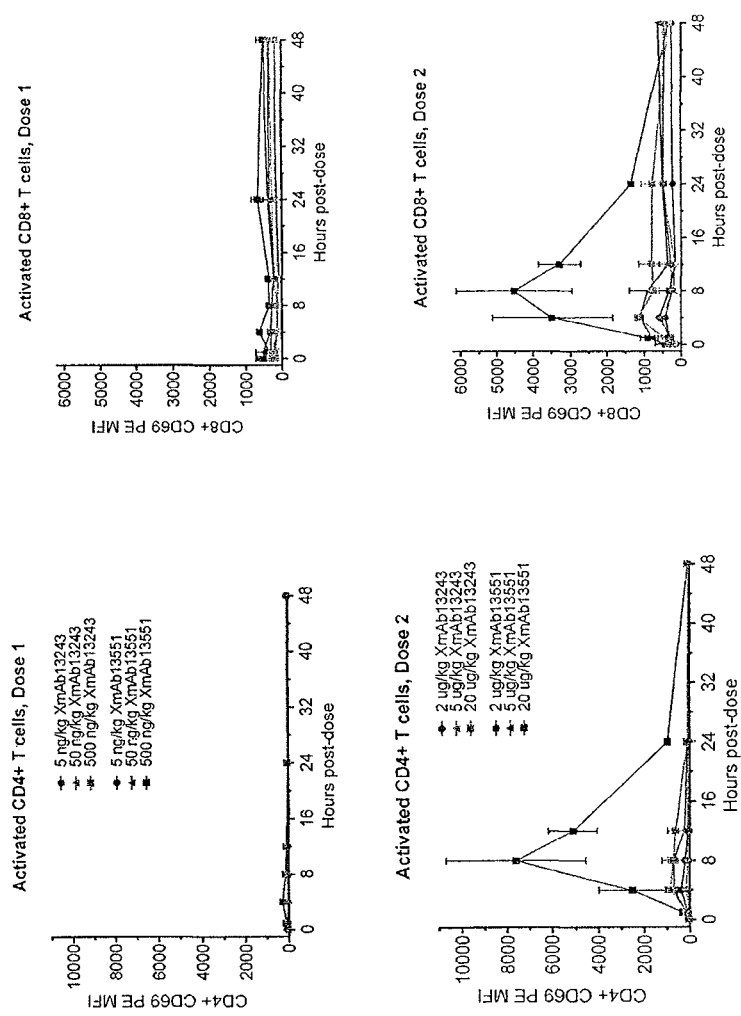
Figure 60C:
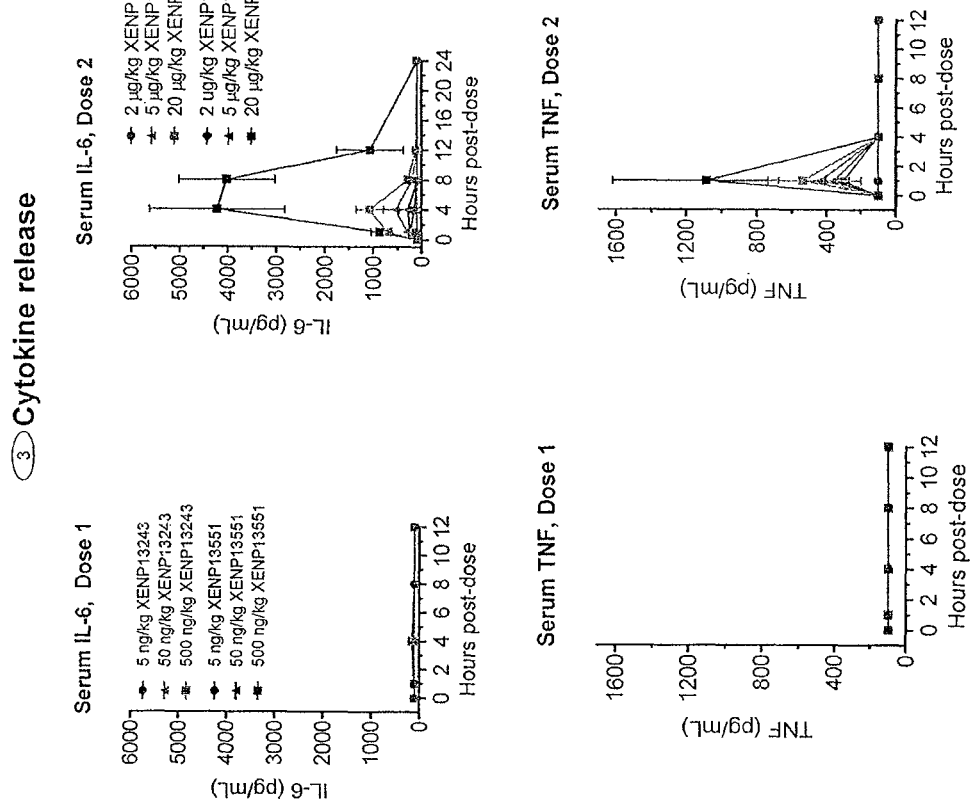

C57BL/6 mice (n=5 per group) were given single 2 mg/kg intravenous doses of anti-CD38×anti-CD3 bispecifics XENP13243 and XENP13551. Mice were bled via orbital sinus puncture (OSP) at 1 hr and at 1, 3, 6, 10, 14, 17 and 21 days post-test article administration, and blood was processed to serum for determination of test article levels. Serum concentrations were determined by immunoassay and are plotted in FIG. 6. Test article half-lifes were determined using the non-compartmental analysis module of Phoenix WinNonlin 6.3. Half-lifes are listed in FIG. 55. Note that inclusion of an Fc region in the design of the bispecifics resulted in half-lifes comparable to typical monoclonal antibodies. Typical non-Fc-containing bispecifics, such as BiTE or DART formats, have much shorter half-lifes on the order of hours.

Example 8. Redirected T Cell Cytotoxicity of CD38+RPMI8226 Cells Mediated by Anti-CD38×Anti-CD3 Bispecifics Anti-CD38×anti-CD3 bispecifics XENP13243 and XENP13551 were used to mediate redirected T cell cytotoxicity of CD38+RPMI 8226 cells. The assay consisted of a 24 h incubation at 37° C. of 10,000 RPMI 8226 cells with 400,000 purified human T cells. Readout of cytotoxicity was by lactate dehydrogenase (LDH). Results are shown in the figures.

Example 9. Binding Affinities of Anti-CD38×Anti-CD3 Bispecifics

Surface plasmon resonance measurements via Biacore 3000 were made of the affinities of XENP13243 and XENP13551 for human and cyno CD38 and CD3. Standard methods were used, and the kinetic parameters were determined using BIAevaluation software. Results are listed in the figures.

Example 10. Depletion of CD38+ Cells in Cynomolgus Monkeys by Anti-CD38×Anti-CD3 Bispecifics Six groups of cynomolgus monkeys (n=2 per group) where administered via intravenous infusion either XENP13243 or XENP13551. Two doses were administered per monkey, separated by 3 weeks. Initial doses were 5, 50, and 500 ng/kg, and secondary doses were 2, 5, and 20 μg/kg. Depletion of CD20-CD38+ cells was observed in a dose dependent manner (see Fig.). Evidence of the recruitment of T cells was seen in the upregulation of CD69 on CD8+ T cells (see Fig.).

SEQUENCE LISTING (553 sequences)

SEQ ID NO: 1 - protein, 125 aa, Artificial Sequence
  Humanized anti-CD3 heavy chain variable region
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 2 - protein, 109 aa, Artificial Sequence
  Humanized anti-CD3 light chain variable region
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 3 - protein, 257 aa, Artificial Sequence
  XENP11502 H1_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 4 - protein, 249 aa, Artificial Sequence
  XENP11502 H1_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 5 - protein, 125 aa, Artificial Sequence; identical to SEQ ID NO: 1
  XENP11502 H1_L1.4

SEQ ID NO: 6 - protein, 109 aa, Artificial Sequence; identical to SEQ ID NO: 2
  XENP11502 H1_L1.4

SEQ ID NO: 7 - protein, 257 aa, Artificial Sequence
  XENP11794 H1.3_L1.4
EVQLVESGGGDVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 8 - protein, 249 aa, Artificial Sequence
  XENP11794 H1.3_L1.4
EVQLVESGGGDVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 9 - protein, 125 aa, Artificial Sequence
  XENP11794 H1.3_L1.4
EVQLVESGGGDVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 10 - protein, 109 aa, Artificial Sequence; identical to SEQ ID NO: 2
  XENP11794 H1.3_L1.4

SEQ ID NO: 11 - protein, 257 aa, Artificial Sequence
  XENP11795 H1.4_L1.4
EVQLVESGGGKVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 12 - protein, 249 aa, Artificial Sequence
  XENP11795 H1.4_L1.4
EVQLVESGGGKVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 13 - protein, 125 aa, Artificial Sequence
  XENP11795 H1.4_L1.4
EVQLVESGGGKVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 14 - protein, 109 aa, Artificial Sequence; identical to SEQ ID NO: 2
  XENP11795 H1.4_L1.4

SEQ ID NO: 15 - protein, 257 aa, Artificial Sequence
  XENP11796 H1.5_L1.4
EVQLVESGGGNVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 16 - protein, 249 aa, Artificial Sequence
  XENP11796 H1.5_L1.4, cont.
EVQLVESGGGNVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 17 - protein, 125 aa, Artificial Sequence
  XENP11796 H1.5_L1.4, cont.
EVQLVESGGGNVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 18 - protein, 109 aa, Artificial Sequence; identical to SEQ ID NO: 2
  XENP11796 H1.5_L1.4, cont.

SEQ ID NO: 19 - protein, 257 aa, Artificial Sequence
  XENP11801 H1.6_L1.4
EVQLVESGGGSVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 20 - protein, 249 aa, Artificial Sequence
  XENP11801 H1.6_L1.4
EVQLVESGGGSVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 21 - protein, 125 aa, Artificial Sequence
  XENP11801 H1.6_L1.4
EVQLVESGGGSVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 22 - protein, 109 aa, Artificial Sequence; identical to SEQ ID NO: 2
  XENP11801 H1.6_L1.4

SEQ ID NO: 23 - protein, 257 aa, Artificial Sequence
  XENP11802 H1.7_L1.4
EVQLVESGGGLVQPGGSLKLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 24 - protein, 249 aa, Artificial Sequence
  XENP11802 H1.7_L1.4
EVQLVESGGGLVQPGGSLKLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 25 - protein, 125 aa, Artificial Sequence
  XENP11802 H1.7_L1.4
EVQLVESGGGLVQPGGSLKLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 26 - protein, 109 aa, Artificial Sequence; identical to SEQ ID NO: 2
  XENP11802 H1.7_L1.4

SEQ ID NO: 27 - protein, 257 aa, Artificial Sequence
  XENP11803 H1.8_L1.4
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 28 - protein, 249 aa, Artificial Sequence
  XENP11803 H1.8_L1.4
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 29 - protein, 125 aa, Artificial Sequence
  XENP11803 H1.8_L1.4
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 30 - protein, 109 aa, Artificial Sequence; identical to SEQ ID NO: 2
  XENP11803 H1.8_L1.4

SEQ ID NO: 31 - protein, 257 aa, Artificial Sequence
  XENP11804 H1.9_L1.4
EVQLVESGGGLVQPGGSLRLSCAASGFTFNTYAMHWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 32 - protein, 249 aa, Artificial Sequence
  XENP11804 H1.9_L1.4
EVQLVESGGGLVQPGGSLRLSCAASGFTFNTYAMHWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 33 - protein, 125 aa, Artificial Sequence
  XENP11804 H1.9_L1.4
EVQLVESGGGLVQPGGSLRLSCAASGFTFNTYAMHWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 34 - protein, 109 aa, Artificial Sequence; identical to SEQ ID NO: 2
  XENP11804 H1.9_L1.4

SEQ ID NO: 35 - protein, 257 aa, Artificial Sequence
  XENP11805 H1.10_L1.4
EVQLVESGGGLVQPGGSLRLSCAASGFTFNTYAMSWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 36 - protein, 249 aa, Artificial Sequence
  XENP11805 H1.10_L1.4
EVQLVESGGGLVQPGGSLRLSCAASGFTFNTYAMSWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 37 - protein, 125 aa, Artificial Sequence
  XENP11805 H1.10_L1.4
EVQLVESGGGLVQPGGSLRLSCAASGFTFNTYAMSWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 38 - protein, 109 aa, Artificial Sequence; identical to SEQ ID NO: 2
  XENP11805 H1.10_L1.4

SEQ ID NO: 39 - protein, 257 aa, Artificial Sequence
  XENP11806 H1.11_L1.4
EVQLVESGGGLVQPGGSLRLSCAASGFTFNTYAMNWVRQASGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 40 - protein, 249 aa, Artificial Sequence
  XENP11806 H1.11_L1.4
EVQLVESGGGLVQPGGSLRLSCAASGFTFNTYAMNWVRQASGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 41 - protein, 125 aa, Artificial Sequence
  XENP11806 H1.11_L1.4
EVQLVESGGGLVQPGGSLRLSCAASGFTFNTYAMNWVRQASGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 42 - protein, 109 aa, Artificial Sequence; identical to SEQ ID NO: 2
  XENP11806 H1.11_L1.4

SEQ ID NO: 43 - protein, 257 aa, Artificial Sequence
  XENP11807 H1.12_L1.4
EVQLVESGGGLVQPGGSLRLSCAASGFTFNTYAMNWVRQAPGKGLEWVGRIRSKANNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 44 - protein, 249 aa, Artificial Sequence
  XENP11807 H1.12_L1.4
EVQLVESGGGLVQPGGSLRLSCAASGFTFNTYAMNWVRQAPGKGLEWVGRIRSKANNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 45 - protein, 125 aa, Artificial Sequence
  XENP11807 H1.12_L1.4
EVQLVESGGGLVQPGGSLRLSCAASGFTFNTYAMNWVRQAPGKGLEWVGRIRSKANNYATYYADSVKGRFTISRDDSKNTLYLQMNSLRAEDTAVYYCVRHGNFGNSYVSWFAYWGQGTLVTVSS

SEQ ID NO: 46 - protein, 109 aa, Artificial Sequence; identical to SEQ ID NO: 2
  XENP11807 H1.12_L1.4

SEQ ID NO: 47 - protein, 257 aa, Artificial Sequence
  XENP11808 H1.13_L1.4
EVQLVESGGGLVQPGGSLRLSCAASGFTFNTYAMNWVRQAPGKGLEWVGRIRSKANSYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 48 - protein, 249 aa, Artificial Sequence
  XENP11808 H1.13_L1.4
EVQLVESGGGLVQPGGSLRLSCAASGFTFNTYAMNWVRQAPGKGLEWVGRIRSKANSYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 49 - protein, 125 aa, Artificial Sequence
  XENP11808 H1.13_L1.4
EVQLVESGGGLVQPGGSLRLSCAASGFTFNTYAMNWVRQAPGKGLEWVGRIRSKANSYATYYADSVKGRFTISRDDSKNTLYLQMNSLRAEDTAVYYCVRHGNFGNSYVSWFAYWGQGTLVTVSS

SEQ ID NO: 50 - protein, 109 aa, Artificial Sequence; identical to SEQ ID NO: 2
  XENP11808 H1.13_L1.4

SEQ ID NO: 51 - protein, 257 aa, Artificial Sequence
  XENP11809 H1.14_L1.4
EVQLVESGGGLVQPGGSLRLSCAASGFTFNTYAMNWVRQAPGKGLEWVGRIRSKYNNYATAYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 52 - protein, 249 aa, Artificial Sequence
  XENP11809 H1.14_L1.4
EVQLVESGGGLVQPGGSLRLSCAASGFTFNTYAMNWVRQAPGKGLEWVGRIRSKYNNYATAYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 53 - protein, 125 aa, Artificial Sequence
  XENP11809 H1.14_L1.4
EVQLVESGGGLVQPGGSLRLSCAASGFTFNTYAMNWVRQAPGKGLEWVGRIRSKYNNYATAYADSVKGRFTISRDDSKNTLYLQMNSLRAEDTAVYYCVRHGNFGNSYVSWFAYWGQGTLVTVSS

SEQ ID NO: 54 - protein, 109 aa, Artificial Sequence; identical to SEQ ID NO: 2
  XENP11809 H1.14_L1.4

SEQ ID NO: 55 - protein, 257 aa, Artificial Sequence
  XENP11810 H1.15_L1.4
EVQLVESGGGLVQPGGSLRLSCAASGFTFNTYAMNWVRQAPGKGLEWVGRIRSKYNNYATYYAASVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 56 - protein, 249 aa, Artificial Sequence
  XENP11810 H1.15_L1.4
EVQLVESGGGLVQPGGSLRLSCAASGFTFNTYAMNWVRQAPGKGLEWVGRIRSKYNNYATYYAASVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 57 - protein, 125 aa, Artificial Sequence
  XENP11810 H1.15_L1.4
EVQLVESGGGLVQPGGSLRLSCAASGFTFNTYAMNWVRQAPGKGLEWVGRIRSKYNNYATYYAASVKGRFTISRDDSKNTLYLQMNSLRAEDTAVYYCVRHGNFGNSYVSWFAYWGQGTLVTVSS

SEQ ID NO: 58 - protein, 109 aa, Artificial Sequence; identical to SEQ ID NO: 2
  XENP11810 H1.15_L1.4

SEQ ID NO: 59 - protein, 257 aa, Artificial Sequence
  XENP11811 H1.16_L1.4
EVQLVESGGGLVQPGGSLRLSCAASGFTFNTYAMNWVRQAPGKGLEWVGRIRSKYNNYATYYADSVKGRFTISRDNSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 60 - protein, 249 aa, Artificial Sequence
  XENP11811 H1.16_L1.4
EVQLVESGGGLVQPGGSLRLSCAASGFTFNTYAMNWVRQAPGKGLEWVGRIRSKYNNYATYYADSVKGRFTISRDNSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 61 - protein, 125 aa, Artificial Sequence
  XENP11811 H1.16_L1.4
EVQLVESGGGLVQPGGSLRLSCAASGFTFNTYAMNWVRQAPGKGLEWVGRIRSKYNNYATYYADSVKGRFTISRDNSKNTLYLQMNSLRAEDTAVYYCVRHGNFGNSYVSWFAYWGQGTLVTVSS

SEQ ID NO: 62 - protein, 109 aa, Artificial Sequence; identical to SEQ ID NO: 2
  XENP11811 H1.16_L1.4

SEQ ID NO: 63 - protein, 257 aa, Artificial Sequence
  XENP11812 H1.17_L1.4
EVQLVESGGGLVQPGGSLRLSCAASGFTFNTYAMNWVRQAPGKGLEWVGRIRSKYNNYATYYADSVKGRFTISRDTSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 64 - protein, 249 aa, Artificial Sequence
  XENP11812 H1.17_L1.4
EVQLVESGGGLVQPGGSLRLSCAASGFTFNTYAMNWVRQAPGKGLEWVGRIRSKYNNYATYYADSVKGRFTISRDTSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 65 - protein, 123 aa, Artificial Sequence
  XENP11812 H1.17_L1.4
EVQLVESGGGLVQPGGSLRLSCAASGFTFNTYAMNWVRQAPGKGLEWVGRIRSKYNNYATYYADSVKGRFTISRDTSKNTLYLQMNSLRAEDTAVYYCVRHGNFGNSYVSWFAYWGQGTLVTV

SEQ ID NO: 66 - protein, 109 aa, Artificial Sequence; identical to SEQ ID NO: 2
  XENP11812 H1.17_L1.4

SEQ ID NO: 67 - protein, 257 aa, Artificial Sequence
  XENP11813 H1.18_L1.4
EVQLVESGGGLVQPGGSLRLSCAASGFTFNTYAMNWVRQAPGKGLEWVGRIRSKYNNYATYYADSVKGRFTISRDDSKNTAYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 68 - protein, 249 aa, Artificial Sequence
  XENP11813 H1.18_L1.4
EVQLVESGGGLVQPGGSLRLSCAASGFTFNTYAMNWVRQAPGKGLEWVGRIRSKYNNYATYYADSVKGRFTISRDDSKNTAYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 69 - protein, 125 aa, Artificial Sequence
  XENP11813 H1.18_L1.4
EVQLVESGGGLVQPGGSLRLSCAASGFTFNTYAMNWVRQAPGKGLEWVGRIRSKYNNYATYYADSVKGRFTISRDDSKNTAYLQMNSLRAEDTAVYYCVRHGNFGNSYVSWFAYWGQGTLVTVSS

SEQ ID NO: 70 - protein, 109 aa, Artificial Sequence; identical to SEQ ID NO: 2
  XENP11813 H1.18_L1.4

SEQ ID NO: 71 - protein, 257 aa, Artificial Sequence
  XENP11814 H1.19_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRDEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 72 - protein, 249 aa, Artificial Sequence
  XENP11814 H1.19_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRDEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 73 - protein, 125 aa, Artificial Sequence
  XENP11814 H1.19_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRDEDTAVYYCVRHGNFGNSYVSWFAYWGQGTLVTVSS

SEQ ID NO: 74 - protein, 109 aa, Artificial Sequence; identical to SEQ ID NO: 2
  XENP11814 H1.19_L1.4

SEQ ID NO: 75 - protein, 257 aa, Artificial Sequence
  XENP11815 H1.20_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRKEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 76 - protein, 249 aa, Artificial Sequence
  XENP11815 H1.20_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRKEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 77 - protein, 125 aa, Artificial Sequence
  XENP11815 H1.20_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRKEDTAVYYCVRHGNFGNSYVSWFAYWGQGTLVTVSS

SEQ ID NO: 78 - protein, 109 aa, Artificial Sequence; identical to SEQ ID NO: 2
  XENP11815 H1.20_L1.4

SEQ ID NO: 79 - protein, 257 aa, Artificial Sequence
  XENP11816 H1.21_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRSEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 80 - skipped

SEQ ID NO: 81 - protein, 125 aa, Artificial Sequence
  XENP11816 H1.21_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRSEDTAVYYCVRHGNFGNSYVSWFAYWGQGTLVTVSS

SEQ ID NO: 82 - protein, 109 aa, Artificial Sequence; identical to SEQ ID NO: 2
  XENP11816 H1.21_L1.4

SEQ ID NO: 83 - protein, 257 aa, Artificial Sequence
  XENP11817 H1.22_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCARHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 84 - protein, 249 aa, Artificial Sequence
  XENP11817 H1.22_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCARHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 85 - protein, 125 aa, Artificial Sequence
  XENP11817 H1.22_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCARHGNFGNSYVSWFAYWGQGTLVTVSS

SEQ ID NO: 86 - protein, 109 aa, Artificial Sequence; identical to SEQ ID NO: 2
  XENP11817 H1.22_L1.4

SEQ ID NO: 87 - protein, 257 aa, Artificial Sequence
  XENP11818 H1.23_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCTRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 88 - protein, 249 aa, Artificial Sequence
  XENP11818 H1.23_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCTRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 89 - protein, 125 aa, Artificial Sequence
  XENP11818 H1.23_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCTRHGNFGNSYVSWFAYWGQGTLVTVSS

SEQ ID NO: 90 - protein, 109 aa, Artificial Sequence; identical to SEQ ID NO: 2
  XENP11818 H1.23_L1.4

SEQ ID NO: 91 - protein, 257 aa, Artificial Sequence
  XENP11819 H1.24_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 92 - protein, 249 aa, Artificial Sequence
  XENP11819 H1.24_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 93 - protein, 125 aa, Artificial Sequence
  XENP11819 H1.24_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 94 - protein, 109 aa, Artificial Sequence; identical to SEQ ID NO: 2
  XENP11819 H1.24_L1.4

SEQ ID NO: 95 - protein, 257 aa, Artificial Sequence
  XENP11820 H1.25_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGQSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 96 - protein, 249 aa, Artificial Sequence
  XENP11820 H1.25_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGQSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 97 - protein, 125 aa, Artificial Sequence
  XENP11820 H1.25_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGQSYVSWFAYWGQGTLVTVSS

SEQ ID NO: 98 - protein, 109 aa, Artificial Sequence; identical to SEQ ID NO: 2
  XENP11820 H1.25_L1.4

SEQ ID NO: 99 - protein, 257 aa, Artificial Sequence
  XENP11821 H1.26_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNTYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 100 - protein, 249 aa, Artificial Sequence
  XENP11821 H1.26_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNTYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 101 - protein, 125 aa, Artificial Sequence
  XENP11821 H1.26_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNTYVSWFAYWGQGTLVTVSS

SEQ ID NO: 102 - protein, 109 aa, Artificial Sequence; identical to SEQ ID NO: 2
  XENP11821 H1.26_L1.4

SEQ ID NO: 103 - protein, 257 aa, Artificial Sequence
  XENP11822 H1.27_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFDYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 104 - protein, 249 aa, Artificial Sequence
  XENP11822 H1.27_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFDYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 105 - protein, 125 aa, Artificial Sequence
  XENP11822 H1.27_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFDYWGQGTLVTVSS

SEQ ID NO: 106 - protein, 109 aa, Artificial Sequence; identical to SEQ ID NO: 2
  XENP11822 H1.27_L1.4

SEQ ID NO: 107 - protein, 257 aa, Artificial Sequence
  XENP11823 H1.28_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTTVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 108 - protein, 249 aa, Artificial Sequence
  XENP11823 H1.28_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTTVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 109 - protein, 125 aa, Artificial Sequence
  XENP11823 H1.28_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTTVTVSS

SEQ ID NO: 110 - protein, 109 aa, Artificial Sequence; identical to SEQ ID NO: 2
  XENP11823 H1.28_L1.4

SEQ ID NO: 111 - protein, 257 aa, Artificial Sequence
  XENP11824 H1.29_L1.30
EVQLVESGGGLVQPGGSLRLSCAASGFTFNTYAMNWVRQAPGKSLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 112 - protein, 249 aa, Artificial Sequence
  XENP11824 H1.29_L1.30
EVQLVESGGGLVQPGGSLRLSCAASGFTFNTYAMNWVRQAPGKSLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 113 - protein, 125 aa, Artificial Sequence
  XENP11824 H1.29_L1.30
EVQLVESGGGLVQPGGSLRLSCAASGFTFNTYAMNWVRQAPGKSLEWVGRIRSKYNNYATYYADSVKGRFTISRDDSKNTLYLQMNSLRAEDTAVYYCVRHGNFGNSYVSWFAYWGQGTLVTVSS

SEQ ID NO: 114 - protein, 109 aa, Artificial Sequence; identical to SEQ ID NO: 2
  XENP11824 H1.29_L1.30

SEQ ID NO: 115 - protein, 257 aa, Artificial Sequence
  XENP11825 H1_L1.10
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQPPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 116 - protein, 249 aa, Artificial Sequence
  XENP11825 H1_L1.10
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQPPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 117 - protein, 125 aa, Artificial Sequence; identical to SEQ ID NO: 1
  XENP11825 H1_L1.10

SEQ ID NO: 118 - protein, 109 aa, Artificial Sequence
  XENP11825 H1_L1.10
QAVVTQPPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 119 - protein, 257 aa, Artificial Sequence
  XENP11826 H1_L1.11
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLSVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 120 - protein, 249 aa, Artificial Sequence
  XENP11826 H1_L1.11
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLSVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 121 - protein, 125 aa, Artificial Sequence; identical to SEQ ID NO: 1
  XENP11826 H1_L1.11

SEQ ID NO: 122 - protein, 109 aa, Artificial Sequence
  XENP11826 H1_L1.11
QAVVTQEPSLSVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 123 - protein, 257 aa, Artificial Sequence
  XENP11827 H1_L1.12
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGATVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 124 - protein, 249 aa, Artificial Sequence
  XENP11827 H1_L1.12
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGATVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 125 - protein, 125 aa, Artificial Sequence; identical to SEQ ID NO: 1
  XENP11827 H1_L1.12

SEQ ID NO: 126 - protein, 109 aa, Artificial Sequence
  XENP11827 H1_L1.12
QAVVTQEPSLTVSPGATVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 127 - protein, 257 aa, Artificial Sequence
  XENP11828 H1_L1.13
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGQTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 128 - protein, 249 aa, Artificial Sequence
  XENP11828 H1_L1.13
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGQTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 129 - protein, 125 aa, Artificial Sequence; identical to SEQ ID NO: 1
  XENP11828 H1_L1.13

SEQ ID NO: 130 - protein, 109 aa, Artificial Sequence
  XENP11828 H1_L1.13
QAVVTQEPSLTVSPGQTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 131 - protein, 257 aa, Artificial Sequence
  XENP11829 H1_L1.14
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTSSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 132 - protein, 249 aa, Artificial Sequence
  XENP11829 H1_L1.14
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTSSNYANWVQQKPGQAPRGLIGGTNKRAPGVPARFSGSLLGGKAALTLSGAQPEDEAEYYCALWYSNLWVFGGGTKLTVL

SEQ ID NO: 133 - protein, 125 aa, Artificial Sequence; identical to SEQ ID NO: 1
  XENP11829 H1_L1.14

SEQ ID NO: 134 - protein, 109 aa, Artificial Sequence
  XENP11829 H1_L1.14
QAVVTQEPSLTVSPGGTVTLTCGSSTGAVTSSNYANWVQQKPGQAPRGLIGGTNKRAPGVPARFSGSLLGGKAALTLSGAQPEDEAEYYCALWYSNLWVFGGGTKLTVL

SEQ ID NO: 135 - protein, 257 aa, Artificial Sequence
  XENP11830 H1_L1.15
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTSGHYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 136 - protein, 249 aa, Artificial Sequence
  XENP11830 H1_L1.15
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTSGHYANWVQQKPGQAPRGLIGGTNKRAPGVPARFSGSLLGGKAALTLSGAQPEDEAEYYCALWYSNLWVFGGGTKLTVL

SEQ ID NO: 137 - protein, 125 aa, Artificial Sequence; identical to SEQ ID NO: 1
  XENP11830 H1_L1.15

SEQ ID NO: 138 - protein, 109 aa, Artificial Sequence
  XENP11830 H1_L1.15
QAVVTQEPSLTVSPGGTVTLTCGSSTGAVTSGHYANWVQQKPGQAPRGLIGGTNKRAPGVPARFSGSLLGGKAALTLSGAQPEDEAEYYCALWYSNLWVFGGGTKLTVL

SEQ ID NO: 139 - protein, 257 aa, Artificial Sequence
  XENP11831 H1_L1.16
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIYDTNKRAPGVPARFSGSLLGGKAALTLSGAQPEDEAEYYCALWYSNLWVFGGGTKLTVLGSHHHHHH

SEQ ID NO: 140 - protein, 249 aa, Artificial Sequence
  XENP11831 H1_L1.16
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIYDTNKRAPGVPARFSGSLLGGKAALTLSGAQPEDEAEYYCALWYSNLWVFGGGTKLTVL

SEQ ID NO: 141 - protein, 125 aa, Artificial Sequence; identical to SEQ ID NO: 1
  XENP11831 H1_L1.16

SEQ ID NO: 142 - protein, 109 aa, Artificial Sequence
  XENP11831 H1_L1.16
QAVVTQEPSLTVSPGGTVTLTCGSSTGAVTTSNYANWVQQKPGQAPRGLIYDTNKRAPGVPARFSGSLLGGKAALTLSGAQPEDEAEYYCALWYSNLWVFGGGTKLTVL

SEQ ID NO: 143 - protein, 257 aa, Artificial Sequence
  XENP11832 H1_L1.17
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNNRAPGVPARFSGSLLGGKAALTLSGAQPEDEAEYYCALWYSNLWVFGGGTKLTVLGSHHHHHH

SEQ ID NO: 144 - protein, 249 aa, Artificial Sequence
  XENP11832 H1_L1.17
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNNRAPGVPARFSGSLLGGKAALTLSGAQPEDEAEYYCALWYSNLWVFGGGTKLTVL

SEQ ID NO: 145 - protein, 125 aa, Artificial Sequence; identical to SEQ ID NO: 1
  XENP11832 H1_L1.17

SEQ ID NO: 146 - protein, 109 aa, Artificial Sequence
  XENP11832 H1_L1.17
QAVVTQEPSLTVSPGGTVTLTCGSSTGAVTTSNYANWVQQKPGQAPRGLIGGTNNRAPGVPARFSGSLLGGKAALTLSGAQPEDEAEYYCALWYSNLWVFGGGTKLTVL

SEQ ID NO: 147 - protein, 257 aa, Artificial Sequence
  XENP11833 H1_L1.18
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRASGVPARFSGSLLGGKAALTLSGAQPEDEAEYYCALWYSNLWVFGGGTKLTVLGSHHHHHH

SEQ ID NO: 148 - protein, 249 aa, Artificial Sequence
  XENP11833 H1_L1.18
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRASGVPARFSGSLLGGKAALTLSGAQPEDEAEYYCALWYSNLWVFGGGTKLTVL

SEQ ID NO: 149 - protein, 125 aa, Artificial Sequence; identical to SEQ ID NO: 1
  XENP11833 H1_L1.18

SEQ ID NO: 150 - protein, 109 aa, Artificial Sequence
  XENP11833 H1_L1.18
QAVVTQEPSLTVSPGGTVTLTCGSSTGAVTTSNYANWVQQKPGQAPRGLIGGTNKRASGVPARFSGSLLGGKAALTLSGAQPEDEAEYYCALWYSNLWVFGGGTKLTVL

SEQ ID NO: 151 - protein, 257 aa, Artificial Sequence
  XENP11834 H1_L1.19
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTSNKHSWTPARFSGSLLGGKAALTLSGAQPEDEAEYYCALWYSNLWVFGGGTKLTVLGSHHHHHH

SEQ ID NO: 152 - protein, 249 aa, Artificial Sequence
  XENP11834 H1_L1.19
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTSNKHSWTPARFSGSLLGGKAALTLSGAQPEDEAEYYCALWYSNLWVFGGGTKLTVL

SEQ ID NO: 153 - protein, 125 aa, Artificial Sequence; identical to SEQ ID NO: 1
  XENP11834 H1_L1.19

SEQ ID NO: 154 - protein, 109 aa, Artificial Sequence
  XENP11834 H1_L1.19
QAVVTQEPSLTVSPGGTVTLTCGSSTGAVTTSNYANWVQQKPGQAPRGLIGGTSNKHSWTPARFSGSLLGGKAALTLSGAQPEDEAEYYCALWYSNLWVFGGGTKLTVL

SEQ ID NO: 155 - protein, 257 aa, Artificial Sequence
  XENP11835 H1_L1.20
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPDRFSGSLLGGKAALTLSGAQPEDEAEYYCALWYSNLWVFGGGTKLTVLGSHHHHHH

SEQ ID NO: 156 - protein, 249 aa, Artificial Sequence
  XENP11835 H1_L1.20
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPDRFSGSLLGGKAALTLSGAQPEDEAEYYCALWYSNLWVFGGGTKLTVL

SEQ ID NO: 157 - protein, 125 aa, Artificial Sequence; identical to SEQ ID NO: 1
  XENP11835 H1_L1.20

SEQ ID NO: 158 - protein, 109 aa, Artificial Sequence
  XENP11835 H1_L1.20
QAVVTQEPSLTVSPGGTVTLTCGSSTGAVTTSNYANWVQQKPGQAPRGLIGGTNKRAPGVPDRFSGSLLGGKAALTLSGAQPEDEAEYYCALWYSNLWVFGGGTKLTVL

SEQ ID NO: 159 - protein, 257 aa, Artificial Sequence
  XENP11836 H1_L1.21
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSKSGGKAALTLSGAQPEDEAEYYCALWYSNLWVFGGGTKLTVLGSHHHHHH

SEQ ID NO: 160 - protein, 249 aa, Artificial Sequence
  XENP11836 H1_L1.21
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSKSGGKAALTLSGAQPEDEAEYYCALWYSNLWVFGGGTKLTVL

SEQ ID NO: 161 - protein, 125 aa, Artificial Sequence; identical to SEQ ID NO: 1
  XENP11836 H1_L1.21

SEQ ID NO: 162 - protein, 109 aa, Artificial Sequence
  XENP11836 H1_L1.21
QAVVTQEPSLTVSPGGTVTLTCGSSTGAVTTSNYANWVQQKPGQAPRGLIGGTNKRAPGVPARFSGSKSGGKAALTLSGAQPEDEAEYYCALWYSNLWVFGGGTKLTVL

SEQ ID NO: 163 - protein, 257 aa, Artificial Sequence
  XENP11837 H1_L1.22
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSSSGGKAALTLSGAQPEDEAEYYCALWYSNLWVFGGGTKLTVLGSHHHHHH

SEQ ID NO: 164 - protein, 249 aa, Artificial Sequence
  XENP11837 H1_L1.22
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSSSGGKAALTLSGAQPEDEAEYYCALWYSNLWVFGGGTKLTVL

SEQ ID NO: 165 - protein, 125 aa, Artificial Sequence; identical to SEQ ID NO: 1
  XENP11837 H1_L1.22

SEQ ID NO: 166 - protein, 109 aa, Artificial Sequence
  XENP11837 H1_L1.22
QAVVTQEPSLTVSPGGTVTLTCGSSTGAVTTSNYANWVQQKPGQAPRGLIGGTNKRAPGVPARFSGSSSGGKAALTLSGAQPEDEAEYYCALWYSNLWVFGGGTKLTVL

SEQ ID NO: 167 - protein, 257 aa, Artificial Sequence
  XENP11838 H1_L1.23
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNLWVFGGGTKLTVLGSHHHHHH

SEQ ID NO: 168 - protein, 249 aa, Artificial Sequence
  XENP11838 H1_L1.23
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNLWVFGGGTKLTVL

SEQ ID NO: 169 - protein, 125 aa, Artificial Sequence; identical to SEQ ID NO: 1
  XENP11838 H1_L1.23

SEQ ID NO: 170 - protein, 109 aa, Artificial Sequence
  XENP11838 H1_L1.23
QAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNLWVFGGGTKLTVL

SEQ ID NO: 171 - protein, 257 aa, Artificial Sequence
  XENP11839 H1_L1.24
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQAEDEAEYYCALWYSNLWVFGGGTKLTVLGSHHHHHH

SEQ ID NO: 172 - protein, 249 aa, Artificial Sequence
  XENP11839 H1_L1.24
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQAEDEAEYYCALWYSNLWVFGGGTKLTVL

SEQ ID NO: 173 - protein, 125 aa, Artificial Sequence; identical to SEQ ID NO: 1
  XENP11839 H1_L1.24

SEQ ID NO: 174 - protein, 109 aa, Artificial Sequence
  XENP11839 H1_L1.24
QAVVTQEPSLTVSPGGTVTLTCGSSTGAVTTSNYANWVQQKPGQAPRGLIGGTNKRAPGVPARFSGSLLGGKAALTLSGAQAEDEAEYYCALWYSNLWVFGGGTKLTVL

SEQ ID NO: 175 - protein, 257 aa, Artificial Sequence
  XENP11840 H1_L1.25
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQSEDEAEYYCALWYSNLWVFGGGTKLTVLGSHHHHHH

SEQ ID NO: 176 - protein, 249 aa, Artificial Sequence
  XENP11840 H1_L1.25
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQSEDEAEYYCALWYSNLWVFGGGTKLTVL

SEQ ID NO: 177 - protein, 125 aa, Artificial Sequence; identical to SEQ ID NO: 1
  XENP11840 H1_L1.25

SEQ ID NO: 178 - protein, 109 aa, Artificial Sequence
  XENP11840 H1_L1.25
QAVVTQEPSLTVSPGGTVTLTCGSSTGAVTTSNYANWVQQKPGQAPRGLIGGTNKRAPGVPARFSGSLLGGKAALTLSGAQSEDEAEYYCALWYSNLWVFGGGTKLTVL

SEQ ID NO: 179 - protein, 257 aa, Artificial Sequence
  XENP11841 H1_L1.26
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEADYYCALWYSNLWVFGGGTKLTVLGSHHHHHH

SEQ ID NO: 180 - protein, 249 aa, Artificial Sequence
  XENP11841 H1_L1.26
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEADYYCALWYSNLWVFGGGTKLTVL

SEQ ID NO: 181 - protein, 125 aa, Artificial Sequence; identical to SEQ ID NO: 1
  XENP11841 H1_L1.26

SEQ ID NO: 182 - protein, 109 aa, Artificial Sequence
  XENP11841 H1_L1.26
QAVVTQEPSLTVSPGGTVTLTCGSSTGAVTTSNYANWVQQKPGQAPRGLIGGTNKRAPGVPARFSGSLLGGKAALTLSGAQPEDEADYYCALWYSNLWVFGGGTKLTVL

SEQ ID NO: 183 - protein, 257 aa, Artificial Sequence
  XENP11842 H1_L1.27
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCLLWYSNLWVFGGGTKLTVLGSHHHHHH

SEQ ID NO: 184 - protein, 249 aa, Artificial Sequence
  XENP11842 H1_L1.27
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCLLWYSNLWVFGGGTKLTVL

SEQ ID NO: 185 - protein, 125 aa, Artificial Sequence; identical to SEQ ID NO: 1
  XENP11842 H1_L1.27

SEQ ID NO: 186 - protein, 109 aa, Artificial Sequence
  XENP11842 H1_L1.27
QAVVTQEPSLTVSPGGTVTLTCGSSTGAVTTSNYANWVQQKPGQAPRGLIGGTNKRAPGVPARFSGSLLGGKAALTLSGAQPEDEAEYYCLLWYSNLWVFGGGTKLTVL

SEQ ID NO: 187 - protein, 257 aa, Artificial Sequence
  XENP11843 H1_L1.28
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNHWVFGGGTKLTVLGSHHHHHH

SEQ ID NO: 188 - protein, 249 aa, Artificial Sequence
  XENP11843 H1_L1.28
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNHWVFGGGTKLTVL

SEQ ID NO: 189 - protein, 125 aa, Artificial Sequence; identical to SEQ ID NO: 1
  XENP11843 H1_L1.28

SEQ ID NO: 190 - protein, 109 aa, Artificial Sequence
  XENP11843 H1_L1.28
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNHWVFGGGTKLTVL

SEQ ID NO: 191 - protein, 257 aa, Artificial Sequence
  XENP11844 H1_L1.29
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLEIKGSHHHHHH

SEQ ID NO: 192 - protein, 251 aa, Artificial Sequence
  XENP11844 H1_L1.29
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLEIKGS

SEQ ID NO: 193 - protein, 125 aa, Artificial Sequence; identical to SEQ ID NO: 1
  XENP11844 H1_L1.29

SEQ ID NO: 194 - protein, 111 aa, Artificial Sequence
  XENP11844 H1_L1.29
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLEIKGS

SEQ ID NO: 195 - protein, 258 aa, Artificial Sequence
  XENP11920 H1_L3.1
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSEIVMTQSPATLSLSPGERATLSCRSSTGAVTTSNYANWVQQKPGQAPRGLIGGTNKRAPGVPARFSGSGSGTDFTLTISSLQPEDFAVYYCALWYSNLWVFGGGTKVEIKGSHHHHHH

SEQ ID NO: 196 - protein, 252 aa, Artificial Sequence
  XENP11920 H1_L3.1
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSEIVMTQSPATLSLSPGERATLSCRSSTGAVTTSNYANWVQQKPGQAPRGLIGGTNKRAPGVPARFSGSGSGTDFTLTISSLQPEDFAVYYCALWYSNLWVFGGGTKVEIKGS

SEQ ID NO: 197 - protein, 125 aa, Artificial Sequence; identical to SEQ ID NO: 1
  XENP11920 H1_L3.1

SEQ ID NO: 198 - protein, 112 aa, Artificial Sequence
  XENP11920 H1_L3.1
EIVMTQSPATLSLSPGERATLSCRSSTGAVTTSNYANWVQQKPGQAPRGLIGGTNKRAPGVPARFSGSGSGTDFTLTISSLQPEDFAVYYCALWYSNLWVFGGGTKVEIKGS

SEQ ID NO: 199 - protein, 258 aa, Artificial Sequence
  XENP11921 H1_L5.1
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSDIVMTQSPDSLAVSLGERATINCKSSTGAVTTSNYANWVQQKPGQPPKGLIGGTNKRAPGVPDRFSGSGSGTDFTLTISSLQAEDVAVYYCALWYSNLWVFGGGTKVEIKGSHHHHHH

SEQ ID NO: 200 - protein, 252 aa, Artificial Sequence
  XENP11921 H1_L5.1
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSDIVMTQSPDSLAVSLGERATINCKSSTGAVTTSNYANWVQQKPGQPPKGLIGGTNKRAPGVPDRFSGSGSGTDFTLTISSLQAEDVAVYYCALWYSNLWVFGGGTKVEIKGS

SEQ ID NO: 201 - protein, 125 aa, Artificial Sequence; identical to SEQ ID NO: 1
  XENP11921 H1_L5.1

SEQ ID NO: 202 - protein, 112 aa, Artificial Sequence
  XENP11921 H1_L5.1
DIVMTQSPDSLAVSLGERATINCKSSTGAVTTSNYANWVQQKPGQPPKGLIGGTNKRAPGVPDRFSGSGSGTDFTLTISSLQAEDVAVYYCALWYSNLWVFGGGTKVEIKGS

SEQ ID NO: 203 - protein, 257 aa, Artificial Sequence
  XENP11922 H1_L1.31
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTDSGAQPEDEADYYCALWYSNHWVFGGGTKLTVLGSHHHHHH

SEQ ID NO: 204 - protein, 249 aa, Artificial Sequence
  XENP11922 H1_L1.31
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTDSGAQPEDEADYYCALWYSNHWVFGGGTKLTVL

SEQ ID NO: 205 - protein, 125 aa, Artificial Sequence; identical to SEQ ID NO: 1
  XENP11922 H1_L1.31

SEQ ID NO: 206 - protein, 109 aa, Artificial Sequence
  XENP11922 H1_L1.31
QAVVTQEPSLTVSPGGTVTLTCGSSTGAVTTSNYANWVQQKPGQAPRGLIGGTNKRAPGVPARFSGSLLGGKAALTDSGAQPEDEADYYCALWYSNHWVFGGGTKLTVL

SEQ ID NO: 207 - protein, 257 aa, Artificial Sequence
  XENP11923 H1_L1.32
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQEKPGQAPRGLIGGTNKRAPGVPARFSGSLLGGKAALTLSGAQPEDEAEYYCALWYSNLWVFGGGTKLTVLGSHHHHHH

SEQ ID NO: 208 - protein, 249 aa, Artificial Sequence
  XENP11923 H1_L1.32
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQEKPGQAPRGLIGGTNKRAPGVPARFSGSLLGGKAALTLSGAQPEDEAEYYCALWYSNLWVFGGGTKLTVL

SEQ ID NO: 209 - protein, 125 aa, Artificial Sequence; identical to SEQ ID NO: 1
  XENP11923 H1_L1.32

SEQ ID NO: 210 - protein, 109 aa, Artificial Sequence
  XENP11923 H1_L1.32
QAVVTQEPSLTVSPGGTVTLTCGSSTGAVTTSNYANWVQEKPGQAPRGLIGGTNKRAPGVPARFSGSLLGGKAALTLSGAQPEDEAEYYCALWYSNLWVFGGGTKLTVL

SEQ ID NO: 211 - protein, 257 aa, Artificial Sequence
  XENP12107 H1.38_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTATYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 212 - protein, 249 aa, Artificial Sequence
  XENP12107 H1.38_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTATYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 213 - protein, 125 aa, Artificial Sequence
  XENP12107 H1.38_L1.4
EVQLVESGGGLVQPGGSLRLSCAASGFTFNTYAMNWVRQAPGKGLEWVGRIRSKYNNYATYYADSVKGRFTISRDDSKNTLYLQMNSLRAEDTATYYCVRHGNFGNSYVSWFAYWGQGTLVTVSS

SEQ ID NO: 214 - protein, 109 aa, Artificial Sequence; identical to SEQ ID NO: 2
  XENP12107 H1.38_L1.4

SEQ ID NO: 215 - protein, 257 aa, Artificial Sequence
  XENP12108 H1_L1.33
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTLSGAQPEDEAEYYCALWYSNLWVFGGGTKLTVLGSHHHHHH

SEQ ID NO: 216 - protein, 249 aa, Artificial Sequence
  XENP12108 H1_L1.33
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTLSGAQPEDEAEYYCALWYSNLWVFGGGTKLTVL

SEQ ID NO: 217 - protein, 125 aa, Artificial Sequence; identical to SEQ ID NO: 1
  XENP12108 H1_L1.33

SEQ ID NO: 218 - protein, 107 aa, Artificial Sequence
  XENP12108 H1_L1.33
QAVVTQEPSLTVSPGGTVTLTCGSSTGAVTTSNYANWVQQKPGKAPRGLIGGTNKRAPGVPARFSGSLLGGKAALTLSGAQPEDEAEYYCALWYSNLWVFGGGTKLT

SEQ ID NO: 219 - protein, 257 aa, Artificial Sequence
  XENP12109 H1_L1.34
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGTAPRGLIGGTNKRAPGVPARFSGSLLGGKAALTLSGAQPEDEAEYYCALWYSNLWVFGGGTKLTVLGSHHHHHH

SEQ ID NO: 220 - protein, 249 aa, Artificial Sequence
  XENP12109 H1_L1.34
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGTAPRGLIGGTNKRAPGVPARFSGSLLGGKAALTLSGAQPEDEAEYYCALWYSNLWVFGGGTKLTVL

SEQ ID NO: 221 - protein, 125 aa, Artificial Sequence; identical to SEQ ID NO: 1
  XENP12109 H1_L1.34

SEQ ID NO: 222 - protein, 109 aa, Artificial Sequence
  XENP12109 H1_L1.34
QAVVTQEPSLTVSPGGTVTLTCGSSTGAVTTSNYANWVQQKPGTAPRGLIGGTNKRAPGVPARFSGSLLGGKAALTLSGAQPEDEAEYYCALWYSNLWVFGGGTKLTVL

SEQ ID NO: 223 - protein, 257 aa, Artificial Sequence
  XENP12110 H1_L1.35
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGSPPRGLIGGTNKRAPGVPARFSGSLLGGKAALTLSGAQPEDEAEYYCALWYSNLWVFGGGTKLTVLGSHHHHHH

SEQ ID NO: 224 - protein, 249 aa, Artificial Sequence
  XENP12110 H1_L1.35
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGSPPRGLIGGTNKRAPGVPARFSGSLLGGKAALTLSGAQPEDEAEYYCALWYSNLWVFGGGTKLTVL

SEQ ID NO: 225 - protein, 125 aa, Artificial Sequence; identical to SEQ ID NO: 1
  XENP12110 H1_L1.35

SEQ ID NO: 226 - protein, 109 aa, Artificial Sequence
  XENP12110 H1_L1.35
QAVVTQEPSLTVSPGGTVTLTCGSSTGAVTTSNYANWVQQKPGSPPRGLIGGTNKRAPGVPARFSGSLLGGKAALTLSGAQPEDEAEYYCALWYSNLWVFGGGTKLTVL

SEQ ID NO: 227 - protein, 257 aa, Artificial Sequence
  XENP12111 H1_L1.36
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQPPRGLIGGTNKRAPGVPARFSGSLLGGKAALTLSGAQPEDEAEYYCALWYSNLWVFGGGTKLTVLGSHHHHHH

SEQ ID NO: 228 - protein, 249 aa, Artificial Sequence
  XENP12111 H1_L1.36
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQPPRGLIGGTNKRAPGVPARFSGSLLGGKAALTLSGAQPEDEAEYYCALWYSNLWVFGGGTKLTVL

SEQ ID NO: 229 - protein, 125 aa, Artificial Sequence; identical to SEQ ID NO: 1
  XENP12111 H1_L1.36

SEQ ID NO: 230 - protein, 109 aa, Artificial Sequence
  XENP12111 H1_L1.36
QAVVTQEPSLTVSPGGTVTLTCGSSTGAVTTSNYANWVQQKPGQPPRGLIGGTNKRAPGVPARFSGSLLGGKAALTLSGAQPEDEAEYYCALWYSNLWVFGGGTKLTVL

SEQ ID NO: 231 - protein, 257 aa, Artificial Sequence
  XENP12112 H1_L1.37
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQGPRGLIGGTNKRAPGVPARFSGSLLGGKAALTLSGAQPEDEAEYYCALWYSNLWVFGGGTKLTVLGSHHHHHH

SEQ ID NO: 232 - protein, 249 aa, Artificial Sequence
  XENP12112 H1_L1.37
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQGPRGLIGGTNKRAPGVPARFSGSLLGGKAALTLSGAQPEDEAEYYCALWYSNLWVFGGGTKLTVL

SEQ ID NO: 233 - protein, 125 aa, Artificial Sequence; identical to SEQ ID NO: 1
  XENP12112 H1_L1.37

SEQ ID NO: 234 - protein, 109 aa, Artificial Sequence
  XENP12112 H1_L1.37
QAVVTQEPSLTVSPGGTVTLTCGSSTGAVTTSNYANWVQQKPGQGPRGLIGGTNKRAPGVPARFSGSLLGGKAALTLSGAQPEDEAEYYCALWYSNLWVFGGGTKLTVL

SEQ ID NO: 235 - protein, 257 aa, Artificial Sequence
  XENP12113 H1_L1.38
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTLSGAQPEDEAEYYCALWYSNLWVFGGGTKLTVLGSHHHHHH

SEQ ID NO: 236 - protein, 249 aa, Artificial Sequence
  XENP12113 H1_L1.38
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTLSGAQPEDEAEYYCALWYSNLWVFGGGTKLTVL

SEQ ID NO: 237 - protein, 125 aa, Artificial Sequence; identical to SEQ ID NO: 1
  XENP12113 H1_L1.38

SEQ ID NO: 238 - protein, 109 aa, Artificial Sequence
  XENP12113 H1_L1.38
QAVVTQEPSLTVSPGGTVTLTCGSSTGAVTTSNYANWVQQKPGQSPRGLIGGTNKRAPGVPARFSGSLLGGKAALTLSGAQPEDEAEYYCALWYSNLWVFGGGTKLTVL

SEQ ID NO: 239 - protein, 257 aa, Artificial Sequence
  XENP12114 H1_L1.39
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQDPRGLIGGTNKRAPGVPARFSGSLLGGKAALTLSGAQPEDEAEYYCALWYSNLWVFGGGTKLTVLGSHHHHHH

SEQ ID NO: 240 - protein, 249 aa, Artificial Sequence
  XENP12114 H1_L1.39
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQDPRGLIGGTNKRAPGVPARFSGSLLGGKAALTLSGAQPEDEAEYYCALWYSNLWVFGGGTKLTVL

SEQ ID NO: 241 - protein, 125 aa, Artificial Sequence; identical to SEQ ID NO: 1
  XENP12114 H1_L1.39

SEQ ID NO: 242 - protein, 109 aa, Artificial Sequence
  XENP12114 H1_L1.39
QAVVTQEPSLTVSPGGTVTLTCGSSTGAVTTSNYANWVQQKPGQDPRGLIGGTNKRAPGVPARFSGSLLGGKAALTLSGAQPEDEAEYYCALWYSNLWVFGGGTKLTVL

SEQ ID NO: 243 - protein, 257 aa, Artificial Sequence
  XENP12131 H1.30_L1.4
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 244 - protein, 249 aa, Artificial Sequence
  XENP12131 H1.30_L1.4
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 245 - protein, 125 aa, Artificial Sequence
  XENP12131 H1.30_L1.4
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 246 - protein, 109 aa, Artificial Sequence; identical to SEQ ID NO: 2
  XENP12131 H1.30_L1.4

SEQ ID NO: 247 - protein, 257 aa, Artificial Sequence
  XENP12132 H1.31_L1.4
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 248 - protein, 249 aa, Artificial Sequence
  XENP12132 H1.31_L1.4
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 249 - protein, 125 aa, Artificial Sequence
  XENP12132 H1.31_L1.4
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 250 - protein, 109 aa, Artificial Sequence; identical to SEQ ID NO: 2
  XENP12132 H1.31_L1.4

SEQ ID NO: 251 - protein, 257 aa, Artificial Sequence
  XENP12133 H1.32_L1.4
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 252 - protein, 249 aa, Artificial Sequence
  XENP12133 H1.32_L1.4
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 253 - protein, 125 aa, Artificial Sequence
  XENP12133 H1.32_L1.4
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS

SEQ ID NO: 254 - protein, 109 aa, Artificial Sequence; identical to SEQ ID NO: 2
  XENP12133 H1.32_L1.4

SEQ ID NO: 255 - protein, 257 aa, Artificial Sequence
  XENP12134 H1.33_L1.4
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 256 - protein, 249 aa, Artificial Sequence
  XENP12134 H1.33_L1.4
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 257 - protein, 125 aa, Artificial Sequence
  XENP12134 H1.33_L1.4
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS

SEQ ID NO: 258 - protein, 109 aa, Artificial Sequence; identical to SEQ ID NO: 2
  XENP12134 H1.33_L1.4

SEQ ID NO: 259 - protein, 257 aa, Artificial Sequence
  XENP12135 H1.34_L1.4
EVQLVESGGGLVQPGGSLRLSCAASGFTFSTYAMSWVRQAPGKGLEWVGRIRSKANNYATYYADSVKGRFTISRDDSKNTLYLQMNSLRAEDTAVYYCVRHGNFGDSYVSWFDYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 260 - protein, 249 aa, Artificial Sequence
  XENP12135 H1.34_L1.4
EVQLVESGGGLVQPGGSLRLSCAASGFTFSTYAMSWVRQAPGKGLEWVGRIRSKANNYATYYADSVKGRFTISRDDSKNTLYLQMNSLRAEDTAVYYCVRHGNFGDSYVSWFDYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 261 - protein, 125 aa, Artificial Sequence
  XENP12135 H1.34_L1.4
EVQLVESGGGLVQPGGSLRLSCAASGFTFSTYAMSWVRQAPGKGLEWVGRIRSKANNYATYYADSVKGRFTISRDDSKNTLYLQMNSLRAEDTAVYYCVRHGNFGDSYVSWFDYWGQGTLVTVSS

SEQ ID NO: 262 - protein, 109 aa, Artificial Sequence; identical to SEQ ID NO: 2
  XENP12135 H1.34_L1.4

SEQ ID NO: 263 - protein, 257 aa, Artificial Sequence
  XENP12136 H1.35_L1.4
EVQLVESGGEVKKPGESLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 264 - protein, 249 aa, Artificial Sequence
  XENP12136 H1.35_L1.4
EVQLVESGGEVKKPGESLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 265 - protein, 125 aa, Artificial Sequence
  XENP12136 H1.35_L1.4
EVQLVESGGEVKKPGESLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 266 - protein, 109 aa, Artificial Sequence; identical to SEQ ID NO: 2
  XENP12136 H1.35_L1.4

SEQ ID NO: 267 - protein, 255 aa, Artificial Sequence
  XENP12137 H1.36_L1.4
EVQLVESGGGLVQPGGSLRLSCAASGFTFNTYAMNWVRQAPGKGLEWVGRIRSNGGSTYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 268 - protein, 247 aa, Artificial Sequence
  XENP12137 H1.36_L1.4
EVQLVESGGGLVQPGGSLRLSCAASGFTFNTYAMNWVRQAPGKGLEWVGRIRSNGGSTYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 269 - protein, 123 aa, Artificial Sequence
  XENP12137 H1.36_L1.4
EVQLVESGGGLVQPGGSLRLSCAASGFTFNTYAMNWVRQAPGKGLEWVGRIRSNGGSTYYADSVKGRFTISRDDSKNTLYLQMNSLRAEDTAVYYCVRHGNFGNSYVSWFAYWGQGTLVTVSS

SEQ ID NO: 270 - protein, 109 aa, Artificial Sequence; identical to SEQ ID NO: 2
  XENP12137 H1.36_L1.4

SEQ ID NO: 271 - protein, 257 aa, Artificial Sequence
  XENP12138 H1.37_L1.4
EVQLVESGGGLVQPGGSLRLSCAASGFTFNTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 272 - protein, 249 aa, Artificial Sequence
  XENP12138 H1.37_L1.4
EVQLVESGGGLVQPGGSLRLSCAASGFTFNTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 273 - protein, 125 aa, Artificial Sequence
  XENP12138 H1.37_L1.4
EVQLVESGGGLVQPGGSLRLSCAASGFTFNTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 274 - protein, 109 aa, Artificial Sequence; identical to SEQ ID NO: 2
  XENP12138 H1.37_L1.4

SEQ ID NO: 275 - protein, 257 aa, Artificial Sequence
  XENP12139 H1.37_L1.32
EVQLVESGGGLVQPGGSLRLSCAASGFTFNTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQEKPGQAPRGLIGGTNKRAPGVPARFSGSLLGGKAALTLSGAQPEDEAEYYCALWYSNLWVFGGGTKLTVLGSHHHHHH

SEQ ID NO: 276 - protein, 249 aa, Artificial Sequence
  XENP12139 H1.37_L1.32
EVQLVESGGGLVQPGGSLRLSCAASGFTFNTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQEKPGQAPRGLIGGTNKRAPGVPARFSGSLLGGKAALTLSGAQPEDEAEYYCALWYSNLWVFGGGTKLTVL

SEQ ID NO: 277 - protein, 125 aa, Artificial Sequence; identical to SEQ ID NO: 273
  XENP12139 H1.37_L1.32

SEQ ID NO: 278 - protein, 109 aa, Artificial Sequence; identical to SEQ ID NO: 210
  XENP12139 H1.37_L1.32

SEQ ID NO: 279 - protein, 257 aa, Artificial Sequence
  XENP12149 H1_L1.40
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVLGSHHHHHH

SEQ ID NO: 280 - protein, 249 aa, Artificial Sequence
  XENP12149 H1_L1.40
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVL

SEQ ID NO: 281 - protein, 125 aa, Artificial Sequence; identical to SEQ ID NO: 1
  XENP12149 H1_L1.40

SEQ ID NO: 282 - protein, 109 aa, Artificial Sequence
  XENP12149 H1_L1.40
QAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVL

SEQ ID NO: 283 - protein, 257 aa, Artificial Sequence
  XENP12213 H1.30_L1.40
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVLGSHHHHHH

SEQ ID NO: 284 - protein, 249 aa, Artificial Sequence
  XENP12213 H1.30_L1.40
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVL

SEQ ID NO: 285 - protein, 125 aa, Artificial Sequence; identical to SEQ ID NO: 245
  XENP12213 H1.30_L1.40

SEQ ID NO: 286 - protein, 109 aa, Artificial Sequence; identical to SEQ ID NO: 282
  XENP12213 H1.30_L1.40

SEQ ID NO: 287 - protein, 257 aa, Artificial Sequence
  XENP12214 H1.8_L1.40
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVLGSHHHHHH

SEQ ID NO: 288 - protein, 249 aa, Artificial Sequence
  XENP12214 H1.8_L1.40
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVL

SEQ ID NO: 289 - protein, 125 aa, Artificial Sequence; identical to SEQ ID NO: 29
  XENP12214 H1.8_L1.40

SEQ ID NO: 290 - protein, 109 aa, Artificial Sequence; identical to SEQ ID NO: 282
  XENP12214 H1.8_L1.40

SEQ ID NO: 291 - protein, 257 aa, Artificial Sequence
  XENP12215 H1.39_L1.40
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVLGSHHHHHH

SEQ ID NO: 292 - protein, 249 aa, Artificial Sequence
  XENP12215 H1.39_L1.40
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVL

SEQ ID NO: 293 - protein, 125 aa, Artificial Sequence
  XENP12215 H1.39_L1.40
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 294 - protein, 109 aa, Artificial Sequence; identical to SEQ ID NO: 282
  XENP12215 H1.39_L1.40

SEQ ID NO: 295 - protein, 257 aa, Artificial Sequence
  XENP12216 H1.40_L1.40
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVLGSHHHHHH

SEQ ID NO: 296 - protein, 249 aa, Artificial Sequence
  XENP12216 H1.40_L1.40
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVL

SEQ ID NO: 297 - protein, 125 aa, Artificial Sequence
  XENP12216 H1.40_L1.40
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 298 - protein, 109 aa, Artificial Sequence; identical to SEQ ID NO: 282
  XENP12216 H1.40_L1.40

SEQ ID NO: 299 - protein, 257 aa, Artificial Sequence
  XENP12217 H1.30_L1.41
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVLGSHHHHHH

SEQ ID NO: 300 - protein, 249 aa, Artificial Sequence
  XENP12217 H1.30_L1.41
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVL

SEQ ID NO: 301 - protein, 125 aa, Artificial Sequence; identical to SEQ ID NO: 245
  XENP12217 H1.30_L1.41

SEQ ID NO: 302 - protein, 109 aa, Artificial Sequence
  XENP12217 H1.30_L1.41
QAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVL

SEQ ID NO: 303 - protein, 257 aa, Artificial Sequence
  XENP12218 H1.8_L1.41
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVLGSHHHHHH

SEQ ID NO: 304 - protein, 249 aa, Artificial Sequence
  XENP12218 H1.8_L1.41
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVL

SEQ ID NO: 305 - protein, 125 aa, Artificial Sequence; identical to SEQ ID NO: 29
  XENP12218 H1.8_L1.41

SEQ ID NO: 306 - protein, 109 aa, Artificial Sequence; identical to SEQ ID NO: 302
  XENP12218 H1.8_L1.41

SEQ ID NO: 307 - protein, 257 aa, Artificial Sequence
  XENP12219 H1.39_L1.41
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVLGSHHHHHH

SEQ ID NO: 308 - protein, 249 aa, Artificial Sequence
  XENP12219 H1.39_L1.41
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVL

SEQ ID NO: 309 - protein, 125 aa, Artificial Sequence; identical to SEQ ID NO: 293
  XENP12219 H1.39_L1.41

SEQ ID NO: 310 - protein, 109 aa, Artificial Sequence; identical to SEQ ID NO: 302
  XENP12219 H1.39_L1.41

SEQ ID NO: 311 - protein, 257 aa, Artificial Sequence
  XENP12220 H1.40_L1.41
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVLGSHHHHHH

SEQ ID NO: 312 - protein, 249 aa, Artificial Sequence
  XENP12220 H1.40_L1.41
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVL

SEQ ID NO: 313 - protein, 125 aa, Artificial Sequence; identical to SEQ ID NO: 297
  XENP12220 H1.40_L1.41

SEQ ID NO: 314 - protein, 109 aa, Artificial Sequence; identical to SEQ ID NO: 302
  XENP12220 H1.40_L1.41

SEQ ID NO: 315 - protein, 257 aa, Artificial Sequence
  XENP12221 H1.30_L1.42
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVLGSHHHHHH

SEQ ID NO: 316 - protein, 249 aa, Artificial Sequence
  XENP12221 H1.30_L1.42
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVL

SEQ ID NO: 317 - protein, 125 aa, Artificial Sequence; identical to SEQ ID NO: 245
  XENP12221 H1.30_L1.42

SEQ ID NO: 318 - protein, 109 aa, Artificial Sequence
  XENP12221 H1.30_L1.42
QAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVL

SEQ ID NO: 319 - protein, 257 aa, Artificial Sequence
  XENP12222 H1.8_L1.42
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVLGSHHHHHH

SEQ ID NO: 320 - protein, 249 aa, Artificial Sequence
  XENP12222 H1.8_L1.42
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVL

SEQ ID NO: 321 - protein, 125 aa, Artificial Sequence; identical to SEQ ID NO: 29
  XENP12222 H1.8_L1.42

SEQ ID NO: 322 - protein, 109 aa, Artificial Sequence; identical to SEQ ID NO: 318
  XENP12222 H1.8_L1.42

SEQ ID NO: 323 - protein, 257 aa, Artificial Sequence
  XENP12223 H1.39_L1.42
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVLGSHHHHHH

SEQ ID NO: 324 - protein, 249 aa, Artificial Sequence
  XENP12223 H1.39_L1.42
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVL

SEQ ID NO: 325 - protein, 125 aa, Artificial Sequence; identical to SEQ ID NO: 293
  XENP12223 H1.39_L1.42

SEQ ID NO: 326 - protein, 109 aa, Artificial Sequence; identical to SEQ ID NO: 318
  XENP12223 H1.39_L1.42

SEQ ID NO: 327 - protein, 257 aa, Artificial Sequence
  XENP12224 H1.40_L1.42
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVLGSHHHHHH

SEQ ID NO: 328 - protein, 249 aa, Artificial Sequence
  XENP12224 H1.40_L1.42
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVL

SEQ ID NO: 329 - protein, 125 aa, Artificial Sequence; identical to SEQ ID NO: 297
  XENP12224 H1.40_L1.42

SEQ ID NO: 330 - protein, 109 aa, Artificial Sequence; identical to SEQ ID NO: 318
  XENP12224 H1.40_L1.42

SEQ ID NO: 331 - protein, 257 aa, Artificial Sequence
  XENP12225 H1.30_L1.43
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVLGSHHHHHH

SEQ ID NO: 332 - protein, 249 aa, Artificial Sequence
  XENP12225 H1.30_L1.43
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVL

SEQ ID NO: 333 - protein, 125 aa, Artificial Sequence; identical to SEQ ID NO: 245
  XENP12225 H1.30_L1.43

SEQ ID NO: 334 - protein, 109 aa, Artificial Sequence
  XENP12225 H1.30_L1.43
QAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVL

SEQ ID NO: 335 - protein, 257 aa, Artificial Sequence
  XENP12226 H1.8_L1.43
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVLGSHHHHHH

SEQ ID NO: 336 - protein, 249 aa, Artificial Sequence
  XENP12226 H1.8_L1.43
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVL

SEQ ID NO: 337 - protein, 125 aa, Artificial Sequence; identical to SEQ ID NO: 29
  XENP12226 H1.8_L1.43

SEQ ID NO: 338 - protein, 109 aa, Artificial Sequence; identical to SEQ ID NO: 334
  XENP12226 H1.8_L1.43

SEQ ID NO: 339 - protein, 257 aa, Artificial Sequence
  XENP12227 H1.39_L1.43
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVLGSHHHHHH

SEQ ID NO: 340 - protein, 249 aa, Artificial Sequence
  XENP12227 H1.39_L1.43
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVL

SEQ ID NO: 341 - protein, 125 aa, Artificial Sequence; identical to SEQ ID NO: 293
  XENP12227 H1.39_L1.43

SEQ ID NO: 342 - protein, 109 aa, Artificial Sequence; identical to SEQ ID NO: 334
  XENP12227 H1.39_L1.43

SEQ ID NO: 343 - protein, 257 aa, Artificial Sequence
  XENP12228 H1.40_L1.43
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVLGSHHHHHH

SEQ ID NO: 344 - protein, 249 aa, Artificial Sequence
  XENP12228 H1.40_L1.43
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVL

SEQ ID NO: 345 - protein, 125 aa, Artificial Sequence; identical to SEQ ID NO: 297
  XENP12228 H1.40_L1.43

SEQ ID NO: 346 - protein, 109 aa, Artificial Sequence; identical to SEQ ID NO: 334
  XENP12228 H1.40_L1.43

SEQ ID NO: 347 - protein, 257 aa, Artificial Sequence
  XENP12229 H1.30_L1.44
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVLGSHHHHHH

SEQ ID NO: 348 - protein, 249 aa, Artificial Sequence
  XENP12229 H1.30_L1.44
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVL

SEQ ID NO: 349 - protein, 125 aa, Artificial Sequence; identical to SEQ ID NO: 245
  XENP12229 H1.30_L1.44

SEQ ID NO: 350 - protein, 109 aa, Artificial Sequence
  XENP12229 H1.30_L1.44
QAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVL

SEQ ID NO: 351 - protein, 257 aa, Artificial Sequence
  XENP12230 H1.8_L1.44
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVLGSHHHHHH

SEQ ID NO: 352 - protein, 249 aa, Artificial Sequence
  XENP12230 H1.8_L1.44
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVL

SEQ ID NO: 353 - protein, 125 aa, Artificial Sequence; identical to SEQ ID NO: 29
  XENP12230 H1.8_L1.44

SEQ ID NO: 354 - protein, 109 aa, Artificial Sequence; identical to SEQ ID NO: 350
  XENP12230 H1.8_L1.44

SEQ ID NO: 355 - protein, 257 aa, Artificial Sequence
  XENP12231 H1.39_L1.44
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVLGSHHHHHH

SEQ ID NO: 356 - protein, 249 aa, Artificial Sequence
  XENP12231 H1.39_L1.44
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVL

SEQ ID NO: 357 - protein, 125 aa, Artificial Sequence; identical to SEQ ID NO: 293
  XENP12231 H1.39_L1.44

SEQ ID NO: 358 - protein, 109 aa, Artificial Sequence; identical to SEQ ID NO: 350
  XENP12231 H1.39_L1.44

SEQ ID NO: 359 - protein, 257 aa, Artificial Sequence
  XENP12232 H1.40_L1.44
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVLGSHHHHHH

SEQ ID NO: 360 - protein, 249 aa, Artificial Sequence
  XENP12232 H1.40_L1.44
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVL

SEQ ID NO: 361 - protein, 125 aa, Artificial Sequence; identical to SEQ ID NO: 297
  XENP12232 H1.40_L1.44

SEQ ID NO: 362 - protein, 109 aa, Artificial Sequence; identical to SEQ ID NO: 350
  XENP12232 H1.40_L1.44

SEQ ID NO: 363 - protein, 256 aa, Artificial Sequence
  XENP12233 H1.30_L1.45
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVLGSHHHHH

SEQ ID NO: 364 - protein, 249 aa, Artificial Sequence
  XENP12233 H1.30_L1.45
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVL

SEQ ID NO: 365 - protein, 125 aa, Artificial Sequence; identical to SEQ ID NO: 245
  XENP12233 H1.30_L1.45

SEQ ID NO: 366 - protein, 109 aa, Artificial Sequence
  XENP12233 H1.30_L1.45
QAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVL

SEQ ID NO: 367 - protein, 257 aa, Artificial Sequence
  XENP12234 H1.8_L1.45
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVLGSHHHHHH

SEQ ID NO: 368 - protein, 249 aa, Artificial Sequence
  XENP12234 H1.8_L1.45
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVL

SEQ ID NO: 369 - protein, 125 aa, Artificial Sequence; identical to SEQ ID NO: 29
  XENP12234 H1.8_L1.45

SEQ ID NO: 370 - protein, 109 aa, Artificial Sequence; identical to SEQ ID NO: 366
  XENP12234 H1.8_L1.45

SEQ ID NO: 371 - protein, 257 aa, Artificial Sequence
  XENP12235 H1.39_L1.45
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVLGSHHHHHH

SEQ ID NO: 372 - protein, 249 aa, Artificial Sequence
  XENP12235 H1.39_L1.45
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVL

SEQ ID NO: 373 - protein, 125 aa, Artificial Sequence; identical to SEQ ID NO: 293
  XENP12235 H1.39_L1.45

SEQ ID NO: 374 - protein, 109 aa, Artificial Sequence; identical to SEQ ID NO: 366
  XENP12235 H1.39_L1.45

SEQ ID NO: 375 - protein, 257 aa, Artificial Sequence
  XENP12236 H1.40_L1.45
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVLGSHHHHHH

SEQ ID NO: 376 - protein, 249 aa, Artificial Sequence
  XENP12236 H1.40_L1.45
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVL

SEQ ID NO: 377 - protein, 125 aa, Artificial Sequence; identical to SEQ ID NO: 297
  XENP12236 H1.40_L1.45

SEQ ID NO: 378 - protein, 109 aa, Artificial Sequence; identical to SEQ ID NO: 366
  XENP12236 H1.40_L1.45

SEQ ID NO: 379 - protein, 257 aa, Artificial Sequence
  XENP12237 H1.30_L1.46
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVLGSHHHHHH

SEQ ID NO: 380 - protein, 249 aa, Artificial Sequence
  XENP12237 H1.30_L1.46
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVL

SEQ ID NO: 381 - protein, 125 aa, Artificial Sequence; identical to SEQ ID NO: 245
  XENP12237 H1.30_L1.46

SEQ ID NO: 382 - protein, 109 aa, Artificial Sequence
  XENP12237 H1.30_L1.46
QAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVL

SEQ ID NO: 383 - protein, 257 aa, Artificial Sequence
  XENP12238 H1.8_L1.46
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVLGSHHHHHH

SEQ ID NO: 384 - protein, 249 aa, Artificial Sequence
  XENP12238 H1.8_L1.46
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVL

SEQ ID NO: 385 - protein, 125 aa, Artificial Sequence; identical to SEQ ID NO: 29
  XENP12238 H1.8_L1.46

SEQ ID NO: 386 - protein, 109 aa, Artificial Sequence; identical to SEQ ID NO: 382
  XENP12238 H1.8_L1.46

SEQ ID NO: 387 - protein, 257 aa, Artificial Sequence
  XENP12239 H1.39_L1.46
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVLGSHHHHHH

SEQ ID NO: 388 - protein, 249 aa, Artificial Sequence
  XENP12239 H1.39_L1.46
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVL

SEQ ID NO: 389 - protein, 125 aa, Artificial Sequence; identical to SEQ ID NO: 293
  XENP12239 H1.39_L1.46

SEQ ID NO: 390 - protein, 109 aa, Artificial Sequence; identical to SEQ ID NO: 382
  XENP12239 H1.39_L1.46

SEQ ID NO: 391 - protein, 257 aa, Artificial Sequence
  XENP12240 H1.40_L1.46
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVLGSHHHHHH

SEQ ID NO: 392 - protein, 249 aa, Artificial Sequence
  XENP12240 H1.40_L1.46
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVL

SEQ ID NO: 393 - protein, 125 aa, Artificial Sequence; identical to SEQ ID NO: 297
  XENP12240 H1.40_L1.46

SEQ ID NO: 394 - protein, 109 aa, Artificial Sequence; identical to SEQ ID NO: 382
  XENP12240 H1.40_L1.46

SEQ ID NO: 395 - protein, 257 aa, Artificial Sequence
  XENP12241 H1.30_L1.47
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 396 - protein, 249 aa, Artificial Sequence
  XENP12241 H1.30_L1.47
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 397 - protein, 125 aa, Artificial Sequence; identical to SEQ ID NO: 245
  XENP12241 H1.30_L1.47

SEQ ID NO: 398 - protein, 109 aa, Artificial Sequence
  XENP12241 H1.30_L1.47
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 399 - protein, 257 aa, Artificial Sequence
  XENP12242 H1.8_L1.47
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 400 - protein, 249 aa, Artificial Sequence
  XENP12242 H1.8_L1.47
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 401 - protein, 125 aa, Artificial Sequence; identical to SEQ ID NO: 29
  XENP12242 H1.8_L1.47

SEQ ID NO: 402 - protein, 109 aa, Artificial Sequence; identical to SEQ ID NO: 398
  XENP12242 H1.8_L1.47

SEQ ID NO: 403 - protein, 257 aa, Artificial Sequence
  XENP12243 H1.39_L1.47
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 404 - protein, 249 aa, Artificial Sequence
  XENP12243 H1.39_L1.47
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 405 - protein, 125 aa, Artificial Sequence; identical to SEQ ID NO: 293
  XENP12243 H1.39_L1.47

SEQ ID NO: 406 - protein, 109 aa, Artificial Sequence; identical to SEQ ID NO: 398
  XENP12243 H1.39_L1.47

SEQ ID NO: 407 - protein, 257 aa, Artificial Sequence
  XENP12244 H1.40_L1.47
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 408 - protein, 249 aa, Artificial Sequence
  XENP12244 H1.40_L1.47
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 409 - protein, 125 aa, Artificial Sequence; identical to SEQ ID NO: 297
  XENP12244 H1.40_L1.47

SEQ ID NO: 410 - protein, 109 aa, Artificial Sequence; identical to SEQ ID NO: 398
  XENP12244 H1.40_L1.47

SEQ ID NO: 411 - protein, 5 aa, Artificial Sequence
  vhCDR1
TYAMN

SEQ ID NO: 412 - protein, 5 aa, Artificial Sequence
  vhCDR1
TYAMS

SEQ ID NO: 413 - protein, 19 aa, Artificial Sequence
  vhCDR2
RIRSKYNNYATYYADSVKG

SEQ ID NO: 414 - protein, 19 aa, Artificial Sequence
  vhCDR2
RIRSKANNYATYYADSVKG

SEQ ID NO: 415 - protein, 17 aa, Artificial Sequence
  vhCDR2
RIRSNGGSTYYADSVKG

SEQ ID NO: 416 - protein, 14 aa, Artificial Sequence
  vhCD3
HGNFGNSYVSWFAY

SEQ ID NO: 417 - protein, 14 aa, Artificial Sequence
  vhCDR3
HGNFGDSYVSWFAY

SEQ ID NO: 418 - protein, 14 aa, Artificial Sequence
  vhCDR3
HGNFGQSYVSWFAY

SEQ ID NO: 419 - protein, 14 aa, Artificial Sequence
  vhCDR3
HGNFGDSYVSWFDY

SEQ ID NO: 420 - protein, 14 aa, Artificial Sequence
  vlCDR1
GSSTGAVTTSNYAN

SEQ ID NO: 421 - protein, 14 aa, Artificial Sequence
  vlCDR1
GSSTGAVTSSNYAN

SEQ ID NO: 422 - protein, 14 aa, Artificial Sequence
  vlCDR1
GSSTGAVTSGHYAN

SEQ ID NO: 423 - protein, 14 aa, Artificial Sequence
  vlCDR1
RSSTGAVTTSNYAN

SEQ ID NO: 424 - protein, 14 aa, Artificial Sequence
  vlCDR1
KSSTGAVTTSNYAN

SEQ ID NO: 425 - protein, 7 aa, Artificial Sequence
  vlCDR2
GTNKRAP

SEQ ID NO: 426 - protein, 7 aa, Artificial Sequence
  vlCDR2
DTNKRAP

SEQ ID NO: 427 - protein, 7 aa, Artificial Sequence
  vlCDR2
GTNNRAP

SEQ ID NO: 428 - protein, 7 aa, Artificial Sequence
  vlCDR2
GTNKRAS

SEQ ID NO: 429 - protein, 5 aa, Artificial Sequence
  uncharged ScFv linker
GGGGS

SEQ ID NO: 430 - protein, 9 aa, Artificial Sequence
  vlCDR3
ALWYSNLWV

SEQ ID NO: 431 - protein, 4 aa, Artificial Sequence
  sequence linker
GFLG

SEQ ID NO: 432 - protein, 5 aa, Artificial Sequence
  vhCDR1
TYAMH

SEQ ID NO: 433 - protein, 9 aa, Artificial Sequence
  vhCDR2
ALWYSNHWV

SEQ ID NO: 434 - protein, 19 aa, Artificial Sequence
  vhCDR2
RIRSKANSYATYYADSVKG

SEQ ID NO: 435 - protein, 5 aa, Artificial Sequence
  vhCDR1
  MISC_FEATURE (5)..(5): Xaa can be Asn, Ser or His
TYAMX

SEQ ID NO: 436 - protein, 20 aa, Artificial Sequence
  vhCDR2
  MISC_FEATURE (6)..(6): Xaa can be Tyr or Ala
  MISC_FEATURE (8)..(8): Xaa can be Asn or Ser
  MISC_FEATURE (12)..(12): Xaa can be Tyr or Ala
  MISC_FEATURE (16)..(16): Xaa can be Asp or Ala
RIRSKXNXYATXYYAXSVKG

SEQ ID NO: 437 - protein, 14 aa, Artificial Sequence
  vhCDR3
  MISC_FEATURE (6)..(6): Xaa can be Asn, Asp or Gln
  MISC_FEATURE (13)..(13): Xaa can be Ala or Asp
HGNFGXSYVSWFXY

SEQ ID NO: 438 - protein, 14 aa, Artificial Sequence
  vlCDR1
  MISC_FEATURE (1)..(1): Xaa can be Gly, Arg or Lys
  MISC_FEATURE (9)..(9): Xaa can be Thr or Ser
  MISC_FEATURE (10)..(10): Xaa can be Ser or Gly
  MISC_FEATURE (11)..(11): Xaa can be Asn or His
XSSTGAVTXXXYAN

SEQ ID NO: 439 - protein, 7 aa, Artificial Sequence
  vlCDR2
  MISC_FEATURE (1)..(1): Xaa can be Gly or Asp
  MISC_FEATURE (4)..(4): Xaa can be Lys or Asn
  MISC_FEATURE (7)..(7): Xaa can be Pro or Ser
XTNXRAX

SEQ ID NO: 440 - protein, 9 aa, Artificial Sequence
  vlCDR3
  MISC_FEATURE (1)..(1): Xaa can be Ala or Leu
  MISC_FEATURE (7)..(7): Xaa can be Leu or His
XLWYSNXWV

SEQ ID NO: 441 - protein, 15 aa, Artificial Sequence
  Gly-Ser 15
GGGGSGGGGSGGGGS

SEQ ID NO: 442 - protein, 18 aa, Artificial Sequence
  Whitlow linker
GSTSGSGKPGSGEGSTKG

SEQ ID NO: 443 - protein, 14 aa, Artificial Sequence
  6paxA_1 (+A)
IRPRAIGGSKPRVA

SEQ ID NO: 444 - protein, 15 aa, Artificial Sequence
  Positive charged scFv linkers +B
GKGGSGKGGSGKGGS

SEQ ID NO: 445 - protein, 15 aa, Artificial Sequence
  GKGGSGKGGSGKGGS +C
GGKGSGGKGSGGKGS

SEQ ID NO: 446 - protein, 15 aa, Artificial Sequence
  Positive charged scFv linkers +D
GGGKSGGGKSGGGKS

SEQ ID NO: 447 - protein, 15 aa, Artificial Sequence
  Positive charged scFv linkers +E
GKGKSGKGKSGKGKS

SEQ ID NO: 448 - protein, 15 aa, Artificial Sequence
  Positive charged scFv linkers +F
GGGKSGGKGSGKGGS

SEQ ID NO: 449 - protein, 15 aa, Artificial Sequence
  Positive charged scFv linkers +G
GKPGSGKPGSGKPGS

SEQ ID NO: 450 - protein, 20 aa, Artificial Sequence
  Positive charged scFv linkers +H
GKPGSGKPGSGKPGSGKPGS

SEQ ID NO: 451 - protein, 20 aa, Artificial Sequence
  Positive charged scFv linkers +I
GKGKSGKGKSGKGKSGKGKS

SEQ ID NO: 452 - protein, 20 aa, Artificial Sequence
  Negative Gly-Ser 15
GGGGSGGGGSGGGGSGGGGS

SEQ ID NO: 453 - protein, 14 aa, Artificial Sequence
  3hsc_2 (-A)
STAGDTHLGGEDFD

SEQ ID NO: 454 - protein, 15 aa, Artificial Sequence
  Negative charged scFv linkers -B
GEGGSGEGGSGEGGS

SEQ ID NO: 455 - protein, 15 aa, Artificial Sequence
  Negative charged scFv linkers -C
GGEGSGGEGSGGEGS

SEQ ID NO: 456 - protein, 15 aa, Artificial Sequence
  Negative charged scFv linkers -D
GGGESGGGESGGGES

SEQ ID NO: 457 - protein, 15 aa, Artificial Sequence
  Negative charged scFv linkers -E
GEGESGEGESGEGES

SEQ ID NO: 458 - protein, 15 aa, Artificial Sequence
  Negative charged scFv linkers -F
GGGESGGEGSGEGGS

SEQ ID NO: 459 - protein, 20 aa, Artificial Sequence
  Negative charged scFv linkers -G
GEGESGEGESGEGESGEGES

SEQ ID NO: 460 - protein, 300 aa, Artificial Sequence
  CD38 (Full Sequence)
MANCEFSPVSGDKPCCRLSRRAQLCLGVSILVLILVVVLAVVVPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 461 - protein, 258 aa, Artificial Sequence
  CD38 (Extracellular domain only)
VPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 462 - protein, 207 aa, Artificial Sequence
  HUMAN T-cell surface glycoprotein CD3 epsilon chain
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 463 - protein, 116 aa, Artificial Sequence
  OKT10 VH
EVKLQESGGGLVQPGGSLKLSCAASGFDFSRSWMNWVRQAPGKGLEWIGEINPDSSTINYTTSLKDKFIISRDNAKNTLYLQMTKVRSEDTALYYCARYGNWFPYWGQGTLVTVSA

SEQ ID NO: 464 - protein, 107 aa, Artificial Sequence
  OKT10 VL
DIVMTQSPKIMPTSVGDRVSVTCKASQNVDTNVAWYQQKPGQSPKALIYSASYRYSGVPDRFTGSGSGTDFTLTITNVQSEDLAEYFCQQYDSYPLTFGAGTKLDLK

SEQ ID NO: 465 - protein, 446 aa, Artificial Sequence
  XENP11855 Heavy chain
EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 466 - protein, 214 aa, Artificial Sequence
  XENP11855 Light chain
DIVMTQSPSSLSASVGDRVTITCRASQNVDTNVAWYQQKPGQSPKALIYSASYRYSGVPDRFTGSGSGTDFTLTISSLQPEDFATYFCQQYDSYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 467 - protein, 445 aa, Artificial Sequence
  Heavy chain 1 (Anti-CD38 H1)
EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 468 - protein, 485 aa, Artificial Sequence
  Heavy chain 2 (Anti-CD3 H1.30 L1.47)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 469 - protein, 214 aa, Artificial Sequence; identical to SEQ ID NO: 466
  Light chain (Anti-CD38 L1)

SEQ ID NO: 470 - protein, 445 aa, Artificial Sequence; identical to SEQ ID NO: 467
  Heavy chain 1 (Anti-CD38 H1)

SEQ ID NO: 471 - protein, 485 aa, Artificial Sequence
  Heavy chain 2 (Anti-CD3 H1.79 L1.48)
EVQLVESGGGLVQPGGSLRLSCAASGFTFSTYAMNWVRQAPGKCLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGCGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 472 - protein, 214 aa, Artificial Sequence; identical to SEQ ID NO: 466
  Light chain (Anti-CD38 L1)

SEQ ID NO: 473 - protein, 445 aa, Artificial Sequence; identical to SEQ ID NO: 467
  Heavy chain 1 (Anti-CD38 H1)

SEQ ID NO: 474 - protein, 485 aa, Artificial Sequence; identical to SEQ ID NO: 468
  Heavy chain 2 (Anti-CD3 H1.30 L1.47)

SEQ ID NO: 475 - protein, 214 aa, Artificial Sequence
  Light chain (Anti-CD38 L1.24)
DIVMTQSPSSLSASVGDRVTITCRASQNVDTWVAWYQQKPGQSPKALIYSASYRYSGVPDRFTGSGSGTDFTLTISSLQPEDFATYFCQQYDSYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 476 - protein, 445 aa, Artificial Sequence; identical to SEQ ID NO: 467
  Heavy chain 1 (Anti-CD38 H1)

SEQ ID NO: 477 - protein, 485 aa, Artificial Sequence; identical to SEQ ID NO: 468
  Heavy chain 2 (Anti-CD3 H1.30 L1.47)

SEQ ID NO: 478 - protein, 214 aa, Artificial Sequence
  Light chain (Anti-CD38 L1.96)
DIVMTQSPSSLSASVGDRVTITCRASQNVDYWVAWYQQKPGQSPKALIYAASWRYSGVPDRFTGSGSGTDFTLTISSLQPEDFATYFCQQYDVYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 479 - protein, 445 aa, Artificial Sequence
  Heavy chain 1 (Anti-CD38 H1.77)
EVQLVESGGGLVQPGGSLRLSCAASGFTFSYSWMNWVRQAPGKGLEWVSEINPQSSTINYATSVKGRFTISRDNSKNTLYLQMNSLRAEDTAVYYCARYGNWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 480 - protein, 485 aa, Artificial Sequence; identical to SEQ ID NO: 468
  Heavy chain 2 (Anti-CD3 H1.30 L1.47)

SEQ ID NO: 481 - protein, 214 aa, Artificial Sequence; identical to SEQ ID NO: 478
  Light chain (Anti-CD38 L1.96)

SEQ ID NO: 482 - protein, 445 aa, Artificial Sequence; identical to SEQ ID NO: 479
  Heavy chain 1 (Anti-CD38 H1.77)

SEQ ID NO: 483 - protein, 485 aa, Artificial Sequence; identical to SEQ ID NO: 468
  Heavy chain 2 (Anti-CD3 H1.30 L1.47)

SEQ ID NO: 484 - protein, 214 aa, Artificial Sequence
  Light chain (Anti-CD38 L1.97)
DIVMTQSPSSLSASVGDRVTITCRASQNVDYWVAWYQQKPGQSPKALIYSASWRYSGVPDRFTGSGSGTDFTLTISSLQPEDFATYFCQQYDVYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 485 - protein, 445 aa, Artificial Sequence
  Heavy chain 1 (Anti-CD38 H1.72)
EVQLVESGGGLVQPGGSLRLSCAASGFDFSYSWMNWVRQAPGKGLEWVSEINPQSSTINYATSVKGRFTISRDNSKNTLYLQMNSLRAEDTAVYYCARYGNWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 486 - protein, 485 aa, Artificial Sequence; identical to SEQ ID NO: 468
  Heavy chain 2 (Anti-CD3 H1.30 L1.47)

SEQ ID NO: 487 - protein, 214 aa, Artificial Sequence; identical to SEQ ID NO: 484
  Light chain (Anti-CD38 L1.97)

SEQ ID NO: 488 - protein, 445 aa, Artificial Sequence
  Heavy chain 1 (Anti-CD38 H1.71)
EVQLVESGGGLVQPGGSLRLSCAASGFTFSRSWMNWVRQAPGKGLEWVSEINPQSSTINYATSVKGRFTISRDNSKNTLYLQMNSLRAEDTAVYYCARYGNWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 489 - protein, 485 aa, Artificial Sequence; identical to SEQ ID NO: 468
  Heavy chain 2 (Anti-CD3 H1.30 L1.47)

SEQ ID NO: 490 - protein, 214 aa, Artificial Sequence; identical to SEQ ID NO: 478
  Light chain (Anti-CD38 L1.96)

SEQ ID NO: 491 - protein, 445 aa, Artificial Sequence; identical to SEQ ID NO: 479
  Heavy chain 1 (Anti-CD38 H1.77)

SEQ ID NO: 492 - protein, 485 aa, Artificial Sequence; identical to SEQ ID NO: 468
  Heavy chain 2 (Anti-CD3 H1.30 L1.47)

SEQ ID NO: 493 - protein, 214 aa, Artificial Sequence; identical to SEQ ID NO: 475
  Light chain (Anti-CD38 L1.24)

SEQ ID NO: 494 - protein, 445 aa, Artificial Sequence; identical to SEQ ID NO: 479
  Heavy chain 1 (Anti-CD38 H1.77)

SEQ ID NO: 495 - protein, 485 aa, Artificial Sequence; identical to SEQ ID NO: 471
  Heavy chain 2 (Anti-CD3 H1.79 L1.48)

SEQ ID NO: 496 - protein, 214 aa, Artificial Sequence; identical to SEQ ID NO: 475
  Light chain (Anti-CD38 L1.24)

SEQ ID NO: 497 - protein, 445 aa, Artificial Sequence; identical to SEQ ID NO: 467
  Heavy chain 1 (Anti-CD38 H1)

SEQ ID NO: 498 - protein, 485 aa, Artificial Sequence; identical to SEQ ID NO: 471
  Heavy chain 2 (Anti-CD3 H1.79 L1.48)

SEQ ID NO: 499 - protein, 214 aa, Artificial Sequence; identical to SEQ ID NO: 475
  Light chain (Anti-CD38 L1.24)

SEQ ID NO: 500 - protein, 445 aa, Artificial Sequence; identical to SEQ ID NO: 467
  Heavy chain 1 (Anti-CD38 H1)

SEQ ID NO: 501 - protein, 485 aa, Artificial Sequence; identical to SEQ ID NO: 471
  Heavy chain 2 (Anti-CD3 H1.79 L1.48)

SEQ ID NO: 502 - protein, 214 aa, Artificial Sequence; identical to SEQ ID NO: 478
  Light chain (Anti-CD38 L1.96)

SEQ ID NO: 503 - protein, 445 aa, Artificial Sequence; identical to SEQ ID NO: 479
  Heavy chain 1 (Anti-CD38 H1.77)

SEQ ID NO: 504 - protein, 485 aa, Artificial Sequence; identical to SEQ ID NO: 471
  Heavy chain 2 (Anti-CD3 H1.79 L1.48)

SEQ ID NO: 505 - protein, 214 aa, Artificial Sequence; identical to SEQ ID NO: 478
  Light chain (Anti-CD38 L1.96)

SEQ ID NO: 506 - protein, 445 aa, Artificial Sequence; identical to SEQ ID NO: 479
  Heavy chain 1 (Anti-CD38 H1.77)

SEQ ID NO: 507 - protein, 485 aa, Artificial Sequence; identical to SEQ ID NO: 471
  Heavy chain 2 (Anti-CD3 H1.79 L1.48)

SEQ ID NO: 508 - protein, 214 aa, Artificial Sequence; identical to SEQ ID NO: 484
  Light chain (Anti-CD38 L1.97)

SEQ ID NO: 509 - protein, 445 aa, Artificial Sequence; identical to SEQ ID NO: 485
  Heavy chain 1 (Anti-CD38 H1.72)

SEQ ID NO: 510 - protein, 485 aa, Artificial Sequence; identical to SEQ ID NO: 471
  Heavy chain 2 (Anti-CD3 H1.79 L1.48)

SEQ ID NO: 511 - protein, 214 aa, Artificial Sequence; identical to SEQ ID NO: 484
  Light chain (Anti-CD38 L1.97)

SEQ ID NO: 512 - protein, 445 aa, Artificial Sequence; identical to SEQ ID NO: 488
  Heavy chain 1 (Anti-CD38 H1.71)

SEQ ID NO: 513 - protein, 485 aa, Artificial Sequence; identical to SEQ ID NO: 471
  Heavy chain 2 (Anti-CD3 H1.79 L1.48)

SEQ ID NO: 514 - protein, 214 aa, Artificial Sequence; identical to SEQ ID NO: 478
  Light chain (Anti-CD38 L1.96)

SEQ ID NO: 515 - protein, 445 aa, Artificial Sequence; identical to SEQ ID NO: 467
  XENP13243 HC-Fab

SEQ ID NO: 516 - protein, 485 aa, Artificial Sequence; identical to SEQ ID NO: 468
  XENP13243 HC-scFv

SEQ ID NO: 517 - protein, 214 aa, Artificial Sequence; identical to SEQ ID NO: 466
  XENP13243 LC

SEQ ID NO: 518 - protein, 254 aa, Artificial Sequence
  scFv of XENP13242 including charged linker
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 519 - protein, 445 aa, Artificial Sequence; identical to SEQ ID NO: 479
  XENP13551 HC-Fab

SEQ ID NO: 520 - protein, 485 aa, Artificial Sequence; identical to SEQ ID NO: 468
  XENP13551 HC-scFv

SEQ ID NO: 521 - protein, 214 aa, Artificial Sequence; identical to SEQ ID NO: 475
  XENP13551 LC

SEQ ID NO: 522 - protein, 254 aa, Artificial Sequence; identical to SEQ ID NO: 518
  scFv of XENP13551 including charged linker

SEQ ID NO: 523 - DNA, 1338 bp, Artificial Sequence
  XENP13243 HC-Fab (XenD08502)
gaagtccagctcgtggagtcgggtggcggcctcgtccagcccggcggctcgctccggctgtcatgcgccgcgagcgggttcgatttcagtcgttcgtggatgaactgggtacgccaggccccgggcaagggcctcgaatgggtctccgagatcaacccggacagcagcacgatcaactacgccacctcggtgaagggccggttcacgatcagccgcgacaactccaagaacaccctctacctgcagatgaactccctgcgcgccgaggacacggccgtctactactgcgcgcgctacggaaactggttcccgtactggggccagggcacactggtcactgtctccagcgcgtccacgaagggcccgtcggtcttccccctggcgccaagctcgaaaagtacgtccggcgggaccgcagcgctgggctgcctggtcaaggactacttccccgagcccgtgaccgtgagctggaactcgggcgcgctgacctccggcgtccacaccttcccggcagtcctccagtcgtcgggcctgtactcgctgtccagcgtcgtcacggtgccgtcgtcctccctgggcacgcagacgtacatctgcaacgtgaaccacaagccgagcgacaccaaggtcgacaagaaggtcgagcccaagtcgtgcgacaagacccacacgtgcccgccgtgcccggccccccctgtcgccggccccagtgtcttcctcttcccgccgaagccgaaggacaccctcatgatctcgcgcacccccgaggtcacctgcgtggtcgtggacgtgaagcacgaggaccctgaggttaagttcaactggtatgtcgacggggtggaggtccacaacgcgaagaccaagccgcgcgaggaggagtacaacagtacgtaccgcgtggtctcggtgctcaccgtcctccaccaggactggctgaacggcaaggaatacaagtgtaaggtcagcaacaaggccttgcccgcccccatcgagaagaccataagcaaggccaagggtcagccaagggaaccgcaggtgtacaccctcccgccctcccgcgaggagatgaccaagaaccaggtatcactgacctgcgacgtgtccgggttctacccgtccgacatcgcggtggagtgggagtccgacggccagccggagaacaactacaagaccacccccccggtactcgactccgacggttcgttcttcctctactccaagctgacggtggacaagtcccggtgggagcaaggcgacgtgttcagctgttccgtcatgcacgaggccctgcacaaccactacacccagaagagtctgtccctctcccctggcaaatga

SEQ ID NO: 524 - DNA, 1458 bp, Artificial Sequence
  XENP13243 HC-scFv (XenD08438)
gaagtccagctcgtggagtcgggcggcggcctcgtgcaaccgggtggctcgctgcggctctcctgcgccgcgtccggcttcacgttctccacctacgccatgaactgggtccgccaggcgccgggcaaggggctcgagtgggtggggcgtatccgctccaagtacaacaactacgcgacgtactacgccgatagcgtaaagggacgcttcacaatctcgcgggacgacagcaagaacaccctttacctccagatgaacagcctgcgcgccgaagacaccgccgtgtactactgtgtccggcacgggaacttcggcgactcctacgtctcgtggttcgcctactggggccagggcaccctcgtcaccgtgtcctcgggaaagccggggagcggaaagccgggttcgggcaagccaggctccggtaagccgggctcgcaggcggtggtgacccaggagccatccctgaccgtgtccccggggggcaccgtcacgctgacttgcggctcctcgaccggtgccgtcaccacctccaactacgccaactgggtgcagcagaagcccggcaagagcccccgcggcctgatcggcggcacgaacaagcgcgcgcccggcgtcccggcccgcttctccggctccctgctgggcgggaaggccgcgctcaccatcagcggcgcgcagcccgaggacgaggccgactactactgcgcgctctggtactcgaaccactgggtcttcggcggcgggaccaagctcaccgtgctcgagccgaagtcctcggacaagacccacacatgccccccctgcccggccccccccgtggcgggcccctctgtcttcctgtttcccccgaagccgaaggacaccctgatgatctcgcgcacgccggaagtgacctgcgtcgtcgtcgacgtgaagcacgaggacccagaggtcaagttcaactggtacgtcgacggcgtcgaggtgcacaacgcgaagacgaagccccgtgaggagcagtacaactccacctaccgggtggtgtcggtgctgacggtgctccaccaggactggctgaacggcaaggagtacaagtgtaaggtctccaacaaggccctcccggcccccatcgagaagaccatctcgaaggccaagggccagccgcgcgagccgcaggtgtacacgctcccgccctcgcgggagcagatgaccaagaaccaggtgaagctgacctgcctcgtgaagggcttctacccgagcgacatcgcggtggagtgggagtccaacggccaaccggagaacaactacaagaccactccgccggtgctggactcggatgggtcgttcttcctctactcgaagctcacggtagacaagtcccgctggcagcagggcaacgtcttctcctgctccgtcatgcacgaggccctccacaaccactatacccagaagtcgctctcgctctccccgggaaagtga

SEQ ID NO: 525 - DNA, 645 bp, Artificial Sequence
  XENP13243 LC (XenD07263)
gacatcgtcatgacgcagtcgccgagcagcctctccgcatcggtgggtgaccgcgtcaccatcacctgccgggcgagccagaacgtcgacaccaacgtggcctggtatcagcagaagccgggccagagtccgaaggccctgatctacagcgcctcgtaccgctactcgggcgtgcccgaccggttcacgggcagcggctcggggacggacttcacgctgaccatctcctcgctgcagccggaggacttcgccacctacttctgccagcagtacgactcctatcccctgacgttcgggggagggaccaagctcgagatcaagcgcaccgtcgccgccccctccgtgttcatcttcccgccgagcgacgagcagctgaagagcgggaccgccagcgtggtgtgcctcctcaacaacttctacccgcgcgaggccaaggtgcagtggaaggtggacaacgcgctgcagagcggcaactcccaagagtccgtgaccgagcaggacagcaaggattccacctattcgctgtcctccaccctgaccctctcgaaggccgactacgagaagcacaaggtgtacgcctgcgaggtcacgcaccagggtctcagcagccccgtcaccaagtccttcaatcggggcgagtgctga

SEQ ID NO: 526 - DNA, 1338 bp, Artificial Sequence
  XENP13551 HC-Fab (XenD08503)
gaagtccagctcgtggagtcgggtggcggcctcgtccagcccggcggctcgctccggctgtcatgcgccgcgagcgggttcactttcagttactcgtggatgaactgggtacgccaggccccgggcaagggcctcgaatgggtctccgagatcaacccgcagagcagcacgatcaactacgccacctcggtgaagggccggttcacgatcagccgcgacaactccaagaacaccctctacctgcagatgaactccctgcgcgccgaggacacggccgtctactactgcgcgcgctacggaaactggttcccgtactggggccagggcacactggtcactgtctccagcgcgtccacgaagggcccgtcggtcttccccctggcgccaagctcgaaaagtacgtccggcgggaccgcagcgctgggctgcctggtcaaggactacttccccgagcccgtgaccgtgagctggaactcgggcgcgctgacctccggcgtccacaccttcccggcagtcctccagtcgtcgggcctgtactcgctgtccagcgtcgtcacggtgccgtcgtcctccctgggcacgcagacgtacatctgcaacgtgaaccacaagccgagcgacaccaaggtcgacaagaaggtcgagcccaagtcgtgcgacaagacccacacgtgcccgccgtgcccggccccccctgtcgccggccccagtgtcttcctcttcccgccgaagccgaaggacaccctcatgatctcgcgcacccccgaggtcacctgcgtggtcgtggacgtgaagcacgaggaccctgaggttaagttcaactggtatgtcgacggggtggaggtccacaacgcgaagaccaagccgcgcgaggaggagtacaacagtacgtaccgcgtggtctcggtgctcaccgtcctccaccaggactggctgaacggcaaggaatacaagtgtaaggtcagcaacaaggccttgcccgcccccatcgagaagaccataagcaaggccaagggtcagccaagggaaccgcaggtgtacaccctcccgccctcccgcgaggagatgaccaagaaccaggtatcactgacctgcgacgtgtccgggttctacccgtccgacatcgcggtggagtgggagtccgacggccagccggagaacaactacaagaccacccccccggtactcgactccgacggttcgttcttcctctactccaagctgacggtggacaagtcccggtgggagcaaggcgacgtgttcagctgttccgtcatgcacgaggccctgcacaaccactacacccagaagagtctgtccctctcccctggcaaatga

SEQ ID NO: 527 - DNA, 1458 bp, Artificial Sequence; identical to SEQ ID NO: 524
  XENP13551 HC-scFv (XenD08438)

SEQ ID NO: 528 - protein, 645 aa, Artificial Sequence
  XENP13551 LC (XenD07821)
GACATCGTCATGACGCAGTCGCCGAGCAGCCTCTCCGCATCGGTGGGTGACCGCGTCACCATCACCTGCCGGGCGAGCCAGAACGTCGACACCTGGGTGGCCTGGTATCAGCAGAAGCCGGGCCAGAGTCCGAAGGCCCTGATCTACAGCGCCTCGTACCGCTACTCGGGCGTGCCCGACCGGTTCACGGGCAGCGGCTCGGGGACGGACTTCACGCTGACCATCTCCTCGCTGCAGCCGGAGGACTTCGCCACCTACTTCTGCCAGCAGTACGACTCCTATCCCCTGACGTTCGGGGGAGGGACCAAGCTCGAGATCAAGCGCACCGTCGCCGCCCCCTCCGTGTTCATCTTCCCGCCGAGCGACGAGCAGCTGAAGAGCGGGACCGCCAGCGTGGTGTGCCTCCTCAACAACTTCTACCCGCGCGAGGCCAAGGTGCAGTGGAAGGTGGACAACGCGCTGCAGAGCGGCAACTCCCAAGAGTCCGTGACCGAGCAGGACAGCAAGGATTCCACCTATTCGCTGTCCTCCACCCTGACCCTCTCGAAGGCCGACTACGAGAAGCACAAGGTGTACGCCTGCGAGGTCACGCACCAGGGTCTCAGCAGCCCCGTCACCAAGTCCTTCAATCGGGGCGAGTGCTGA

SEQ ID NO: 529 - protein, 125 aa, Artificial Sequence; identical to SEQ ID NO: 249
  alpha CD3_H1.31_L1.47 VH

SEQ ID NO: 530 - protein, 109 aa, Artificial Sequence; identical to SEQ ID NO: 398
  alpha CD3_H1.31_L1.47 VL

SEQ ID NO: 531 - protein, 125 aa, Artificial Sequence; identical to SEQ ID NO: 253
  alpha CD3_H1.32_L1.47 VH

SEQ ID NO: 532 - protein, 109 aa, Artificial Sequence; identical to SEQ ID NO: 398
  alpha CD3_H1.32_L1.47 VL

SEQ ID NO: 533 - protein, 125 aa, Artificial Sequence; identical to SEQ ID NO: 257
  alpha CD3_H1.33_L1.47 VH

SEQ ID NO: 534 - protein, 109 aa, Artificial Sequence; identical to SEQ ID NO: 398
  alpha CD3_H1.33_L1.47 VL

SEQ ID NO: 535 - protein, 125 aa, Artificial Sequence
  alpha CD3_H1.89_L1.47 VH
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS

SEQ ID NO: 536 - protein, 109 aa, Artificial Sequence; identical to SEQ ID NO: 398
  alpha CD3_H1.89_L1.47 VL

SEQ ID NO: 537 - protein, 125 aa, Artificial Sequence
  alpha CD3_H1.90_L1.47 VH
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS

SEQ ID NO: 538 - protein, 109 aa, Artificial Sequence; identical to SEQ ID NO: 398
  alpha CD3_H1.90_L1.47 VL

SEQ ID NO: 539 - protein, 5 aa, Artificial Sequence
  useful linkers
GSGGS

SEQ ID NO: 540 - protein, 4 aa, Artificial Sequence
  useful linkers
GGGS

SEQ ID NO: 541 - protein, 5 aa, Artificial Sequence
  Synthetic Polypeptide
RSWMN

SEQ ID NO: 542 - protein, 17 aa, Artificial Sequence
  Synthetic Polypeptide
EINPDSSTINYATSVKG

SEQ ID NO: 543 - protein, 7 aa, Artificial Sequence
  Synthetic Polypeptide
YGNWFPY

SEQ ID NO: 544 - protein, 11 aa, Artificial Sequence
  Synthetic Polypeptide
RASQNVDTWVA

SEQ ID NO: 545 - protein, 7 aa, Artificial Sequence
  Synthetic Polypeptide
SASYRYS

SEQ ID NO: 546 - protein, 9 aa, Artificial Sequence
  Synthetic Polypeptide
QQYDSYPLT

SEQ ID NO: 547 - protein, 11 aa, Artificial Sequence
  Synthetic Polypeptide
RASQNVDTNVA

SEQ ID NO: 548 - protein, 11 aa, Artificial Sequence
  Synthetic Polypeptide
RASQNVDYWVA

SEQ ID NO: 549 - protein, 7 aa, Artificial Sequence
  Synthetic Polypeptide
AASWRYS

SEQ ID NO: 550 - protein, 9 aa, Artificial Sequence
  Synthetic Polypeptide
QQYDVYPLT

SEQ ID NO: 551 - protein, 5 aa, Artificial Sequence
  Synthetic Polypeptide
YSWMN

SEQ ID NO: 552 - protein, 17 aa, Artificial Sequence
  Synthetic Polypeptide
EINPQSSTINYATSVKG

SEQ ID NO: 553 - protein, 7 aa, Artificial Sequence
  Synthetic Polypeptide
SASWRYS

We claim:
1. A heterodimeric antibody comprising:
 a) a first heavy chain comprising:
  i) a first Fc domain variant;
  ii) a single chain Fv region (scFv) that binds CD3; and
 b) a second heavy chain comprising:
  i) a second Fc domain variant; and
  ii) a first variable heavy domain; and
 c) a first light chain comprising a first variable light domain and a first constant light domain; wherein said first variable heavy domain and said first variable light domain bind to CD38 and comprise CDR sequences selected from the group consisting of
 (a) first variable heavy domain CDR sequences RSWMN (SEQ ID NO: 541), EINPDSSTINYATSVKG (SEQ ID NO: 542), and YGNWFPY (SEQ ID NO: 543) and first variable light domain CDR sequences RASQNVDTWVA (SEQ ID NO: 544), SASYRYS (SEQ ID NO: 545), and QQYDSYPLT (SEQ ID NO: 546);
 (b) first variable heavy domain CDR sequences RSWMN (SEQ ID NO: 541), EINPDSSTINYATSVKG (SEQ ID NO: 542), and YGNWFPY(SEQ ID NO: 543) and first variable light domain CDR sequences RASQNVDTNVA (SEQ ID NO: 547), SASYRYS (SEQ ID NO: 545), and QQYDSYPLT (SEQ ID NO: 546);
 (c) first variable heavy domain CDR sequences RSWMN (SEQ ID NO: 541), EINPDSSTINYATSVKG (SEQ ID NO: 542), and YGNWFPY (SEQ ID NO: 543) and first variable light domain CDR sequences RASQNVDYWVA (SEQ ID NO: 548), AASWRYS (SEQ ID NO: 549), and QQYDVYPLT (SEQ ID NO: 550);
 (d) first variable heavy domain CDR sequences YSWMN (SEQ ID NO: 551), EINPQSSTINYATSVKG (SEQ ID NO: 552), and YGNWFPY (SEQ ID NO: 543) and first variable light domain CDR sequences RASQNVDYWVA (SEQ ID NO: 548), AASWRYS (SEQ ID NO: 549), and QQYDVYPLT (SEQ ID NO: 550);
 (e) first variable heavy domain CDR sequences YSWMN (SEQ ID NO: 551), EINPQSSTINYATSVKG (SEQ ID NO: 552), and YGNWFPY (SEQ ID NO: 543) and first variable light domain CDR sequences RASQNVDYWVA (SEQ ID NO: 548), SASWRYS (SEQ ID NO: 553), and QQYDVYPLT (SEQ ID NO: 550);
 (f) first variable heavy domain CDR sequences YSWMN (SEQ ID NO: 551), EINPQSSTINYATSVKG (SEQ ID NO: 552), and YGNWFPY (SEQ ID NO: 543) and first variable light domain CDR sequences RASQNVDYWVA (SEQ ID NO: 548), SASWRYS (SEQ ID NO: 553), and QQYDVYPLT (SEQ ID NO: 550);

(g) first variable heavy domain CDR sequences RSWMN (SEQ ID NO: 541), EINPQSSTINYATSVKG (SEQ ID NO: 552), and YGNWFPY (SEQ ID NO: 543) and first variable light domain CDR sequences RASQNVDYWVA (SEQ ID NO: 548), AASWRYS (SEQ ID NO: 549), and QQYDVYPLT (SEQ ID NO: 550); and (h) first variable heavy domain CDR sequences YSWMN (SEQ ID NO: 551), EINPQSSTINYATSVKG (SEQ ID NO: 552), and YGNWFPY (SEQ ID NO: 543) and first variable light domain CDR sequences RASQNVDTWVA (SEQ ID NO: 544), SASYRYS (SEQ ID NO: 545), and QQYDSYPLT (SEQ ID NO: 546).

2. The heterodimeric antibody according to claim 1, wherein the first variable heavy domain comprises CDR sequences RSWMN (SEQ ID NO: 541), EINPDSSTINYATSVKG (SEQ ID NO: 542), and YGNWFPY (SEQ ID NO: 543) and the first variable light domain comprises CDR sequences RASQNVDTWVA (SEQ ID NO: 544), SASYRYS (SEQ ID NO: 545), and QQYDSYPLT (SEQ ID NO: 546).

3. The heterodimeric antibody according to claim 1 wherein said scFv has a charged scFv linker.

4. The heterodimeric antibody according to claim 3 wherein charged scFv linker has a positive charge from 3 to 8 and is selected from the group consisting of SEQ ID NO:s 443 to 451.

5. A pharmaceutical composition comprising the heterodimeric antibody of claim 1.

6. The heterodimeric antibody of claim 1, wherein the first heavy chain comprises the Fc domain of SEQ ID NO: 520.

7. The heterodimeric antibody of claim 1, wherein the first heavy chain comprises amino acids 255-485 of SEQ ID NO: 520.

8. The heterodimeric antibody of claim 2, wherein the first heavy chain comprises the Fc domain of SEQ ID NO: 520.

9. The heterodimeric antibody of claim 2, wherein the first heavy chain comprises amino acids 255-485 of SEQ ID NO: 520.

10. The heterodimeric antibody of claim 3, wherein the first heavy chain comprises the Fc domain of SEQ ID NO: 520.

11. The heterodimeric antibody of claim 3, wherein the first heavy chain comprises amino acids 255-485 of SEQ ID NO: 520.

12. The heterodimeric antibody of claim 4, wherein the first heavy chain comprises the Fc domain of SEQ ID NO: 520.

13. The heterodimeric antibody of claim 4, wherein the first heavy chain comprises amino acids 255-485 of SEQ ID NO: 520.

14. A nucleic acid composition comprising:
a) a first nucleic acid encoding the first heavy chain of claim 1;
b) a second nucleic acid encoding the second heavy chain of claim 1; and
c) a third nucleic acid encoding said light chain.

15. A nucleic acid composition comprising:
a) a first expression vector comprising a first nucleic acid encoding the first heavy chain of claim 1;
b) a second expression vector comprising a second nucleic acid encoding the second heavy chain of claim 1; and
c) a third expression vector comprising a third nucleic acid encoding said light chain.

16. A host cell comprising the nucleic acid composition of claim 14.

17. A host cell comprising the nucleic acid comprising of claim 15.

18. A method of producing a heterodimeric antibody according claim 1 comprising:
a) providing a first expression vector comprising a first nucleic acid encoding a first heavy chain comprising:
 i) a first Fc domain; and
 ii) a first variable heavy chain; and
b) providing a second expression vector comprising a second nucleic acid encoding a second heavy chain comprising:
 i) a first Fc domain; and
 ii) a single chain Fv region (scFv) that binds CD3; and
c) providing a third expression vector comprising nucleic acid comprising a light chain; wherein said first variable heavy chain and the variable light domain of said light chain bind CD38;
d) wherein said first, second and third expression vectors are transfected into host cells at a ratio selected from the group consisting of 1:1.5:1.5, 1:2:1.5, 1:0.667:2, 1:1:2, 1:1.5:2, and 1:2:2;
e) expressing said first, second and third nucleic acids in said host cells to produce a first, second and third amino acid sequence, respectively, such that said first, second and third amino acid sequences form said heterodimeric antibody.

19. The method of claim 18, further comprising (f) formulating the heterodimeric antibody into a pharmaceutical composition.

20. A method of treating a patient in need thereof by administering a heterodimeric antibody according to claim 1.

* * * * *